United States Patent 11,788,075 (ENGINEERED POLYMERASES WITH REDUCED SEQUENCE-SPECIFIC ERRORS) - sequence listing, part 2

SEQ ID NO: 1966 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLELEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1967 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGNEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1968 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1969 - protein, 792 aa, synthetic construct; identical to SEQ ID NO: 1784
  REGION 1..792: note = Description of Artificial Sequence: Synthetic polypeptide

SEQ ID NO: 1970 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDNIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1971 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYFELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1972 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRESAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1973 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1974 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLNEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1975 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1976 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANEFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1977 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGNNYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1978 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1979 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVKQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1980 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVKQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1981 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKVLKILANSFYGYMGYPRARWYRKECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1982 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLPKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1983 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1984 - protein, 792 aa, synthetic construct; identical to SEQ ID NO: 1617
  REGION 1..792: note = Description of Artificial Sequence: Synthetic polypeptide

SEQ ID NO: 1985 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVYIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1986 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1987 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYAELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1988 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1989 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1990 - protein, 792 aa, synthetic construct; identical to SEQ ID NO: 1491
  REGION 1..792: note = Description of Artificial Sequence: Synthetic polypeptide

SEQ ID NO: 1991 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRTVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1992 - protein, 792 aa, synthetic construct; identical to SEQ ID NO: 1503
  REGION 1..792: note = Description of Artificial Sequence: Synthetic polypeptide

SEQ ID NO: 1993 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1994 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1995 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCEISTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1996 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVKQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1997 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLNEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1998 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGDMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1999 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANNFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2000 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2001 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 2002 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVRGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2003 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVDPGMIIGYIITKGTKGISQRATPVEFARLEDYDPEYYIDNQILPAIQRIFEAIGYTRDYLKEGITQTSLSRWF

SEQ ID NO: 2004 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2005 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2006 - protein, 792 aa, synthetic construct; identical to SEQ ID NO: 1326
  REGION 1..792: note = Description of Artificial Sequence: Synthetic polypeptide

SEQ ID NO: 2007 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDTQILPAIQRIFEAIGYTRDYLKEGITQTSLSRWF

SEQ ID NO: 2008 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIYVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2009 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2010 - protein, 792 aa, synthetic construct; identical to SEQ ID NO: 1874
  REGION 1..792: note = Description of Artificial Sequence: Synthetic polypeptide

SEQ ID NO: 2011 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2012 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVNGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2013 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2014 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2015 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANDFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2016 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2017 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVKQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2018 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2019 - protein, 792 aa, synthetic construct; identical to SEQ ID NO: 1498
  REGION 1..792: note = Description of Artificial Sequence: Synthetic polypeptide

SEQ ID NO: 2020 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2021 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYGASIIVSHNIDPSTLIVGNCEENRAPELEYCFSLEREGFIPAILKELIRRRAEIKRELKRSEGDRRRTLSFAEKLLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2022 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2023 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2024 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVLIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2025 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYYELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2026 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANKFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2027 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2028 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2029 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRFVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2030 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2031 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 2032 - protein, 792 aa, synthetic construct; identical to SEQ ID NO: 1770
  REGION 1..792: note = Description of Artificial Sequence: Synthetic polypeptide

SEQ ID NO: 2033 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVKQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2034 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 2035 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYREECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2036 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFAGSIIVSHNIDPSTLIVGNCEENRAPELEYCFSLEREGFIPAILKELIRRRAEIKRELKRSEGDRRRTLSFAEKVLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2037 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLYMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2038 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2039 - protein, 792 aa, synthetic construct; identical to SEQ ID NO: 1519
  REGION 1..792: note = Description of Artificial Sequence: Synthetic polypeptide

SEQ ID NO: 2040 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSHAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2041 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2042 - protein, 792 aa, synthetic construct; identical to SEQ ID NO: 1725
  REGION 1..792: note = Description of Artificial Sequence: Synthetic polypeptide

SEQ ID NO: 2043 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2044 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVKQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2045 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVKQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2046 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVGRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2047 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2048 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2049 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2050 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2051 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVGRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKVLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2052 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2053 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRYVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2054 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVKQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2055 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDYPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2056 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2057 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSAAASIIVSHNIDPSTLIVGNCEENRAPELEYCFSLEREGFIPAILKELIRRRAEIKRELKRSEGDRRRTLSFAEKLLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2058 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYGASIIVSHNIDPSTLIVGNCEENRAPELEYCFSLEREGFIPAILKELIRRRAEIKRELKRSEGDRRRTLSFAEKSLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2059 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2060 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2061 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2062 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2063 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2064 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2065 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2066 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2067 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2068 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLSPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2069 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVIRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2070 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLRPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2071 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTRLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2072 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGQLPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2073 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2074 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLDLAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2075 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2076 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEERAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2077 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2078 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVTEPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2079 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRENAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2080 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2081 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYKELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2082 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2083 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2084 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2085 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2086 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2087 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2088 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARAQATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2089 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYNELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2090 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2091 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLQLAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2092 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2093 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2094 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEVLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2095 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKTISQRATPVEFARLEDYDPEYYIDNQILPAIQRIFEAIGYTRDYLKEGITQTSLSRWF

SEQ ID NO: 2096 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKRELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2097 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRREPAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2098 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2099 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEAEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2100 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEAEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2101 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2102 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2103 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVDEPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2104 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2105 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2106 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKELEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2107 - protein, 773 aa, synthetic construct
  REGION 1..773: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIG

SEQ ID NO: 2108 - protein, 772 aa, synthetic construct
  REGION 1..772: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAI

SEQ ID NO: 2109 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2110 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISDRATPVEFARLEDYDPEYYIDNQILPAIQRIFEAIGYTRDYLKEGITQTSLSRWF

SEQ ID NO: 2111 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEERAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2112 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKTLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2113 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2114 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2115 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRAELARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2116 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2117 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTLLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2118 - protein, 772 aa, synthetic construct
  REGION 1..772: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAI

SEQ ID NO: 2119 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2120 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLNTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2121 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEAEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2122 - protein, 789 aa, synthetic construct
  REGION 1..789: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLS

SEQ ID NO: 2123 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGAMPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2124 - protein, 773 aa, synthetic construct
  REGION 1..773: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIG

SEQ ID NO: 2125 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2126 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 2127 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2128 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKEISQRATPVEFARLEDYDPEYYIDNQILPAIQRIFEAIGYTRDYLKEGITQTSLSRWF

SEQ ID NO: 2129 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEAEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2130 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHFDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2131 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYDELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2132 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQEIFEAIGYTRDYLKEGITQTSLSRWF

SEQ ID NO: 2133 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2134 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2135 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDIYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2136 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRREDAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2137 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2138 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2139 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEAEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2140 - protein, 791 aa, synthetic construct
  REGION 1..791: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2141 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2142 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGIRQRATPVEFARLEDYDPEYYIDNQILPAIQRIFEAIGYTRDYLKEGITQTSLSRWF

SEQ ID NO: 2143 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKEYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2144 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2145 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2146 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGMLPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2147 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKSISQRATPVEFARLEDYDPEYYIDNQILPAIQRIFEAIGYTRDYLKEGITQTSLSRWF

SEQ ID NO: 2148 - protein, 784 aa, synthetic construct
  REGION 1..784: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGIT

SEQ ID NO: 2149 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKREKAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2150 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 2151 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2152 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKRLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2153 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2154 - protein, 784 aa, synthetic construct
  REGION 1..784: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGIT

SEQ ID NO: 2155 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGNIIGYIITKGTKGISQRATPVEFARLEDYDPEYYIDNQILPAIQRIFEAIGYTRDYLKEGITQTSLSRWF

SEQ ID NO: 2156 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEAEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2157 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 2158 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGTIIGYIITKGTKGISQRATPVEFARLEDYDPEYYIDNQILPAIQRIFEAIGYTRDYLKEGITQTSLSRWF

SEQ ID NO: 2159 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYINNQILPAIQRIFEAIGYTRDYLKEGITQTSLSRWF

SEQ ID NO: 2160 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGNLPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2161 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTRLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2162 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEAEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2163 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2164 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2165 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYPELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2166 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKPISQRATPVEFARLEDYDPEYYIDNQILPAIQRIFEAIGYTRDYLKEGITQTSLSRWF

SEQ ID NO: 2167 - protein, 773 aa, synthetic construct
  REGION 1..773: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIG

SEQ ID NO: 2168 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTSLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2169 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2170 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTSLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2171 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEAEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2172 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2173 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAADARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2174 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWNEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2175 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSYYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2176 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTLLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2177 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLENVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2178 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2179 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2180 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2181 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2182 - protein, 776 aa, synthetic construct
  REGION 1..776: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTR

SEQ ID NO: 2183 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2184 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2185 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWEEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2186 - protein, 791 aa, synthetic construct
  REGION 1..791: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRR

SEQ ID NO: 2187 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYQPEYYIDNQILPAIQRIFEAIGYTRDYLKEGITQTSLSRWF

SEQ ID NO: 2188 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGARPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2189 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVVEPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2190 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRAELARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2191 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEAEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2192 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARRTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2193 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2194 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2195 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVYRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2196 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGERYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2197 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEQKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2198 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGIEQRATPVEFARLEDYDPEYYIDNQILPAIQRIFEAIGYTRDYLKEGITQTSLSRWF

SEQ ID NO: 2199 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEAEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2200 - protein, 789 aa, synthetic construct
  REGION 1..789: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLS

SEQ ID NO: 2201 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARATSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2202 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRRR

SEQ ID NO: 2203 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRSALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2204 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISERATPVEFARLEDYDPEYYIDNQILPAIQRIFEAIGYTRDYLKEGITQTSLSRWF

SEQ ID NO: 2205 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2206 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARTTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2207 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARATATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2208 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISSRATPVEFARLEDYDPEYYIDNQILPAIQRIFEAIGYTRDYLKEGITQTSLSRWF

SEQ ID NO: 2209 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRREKAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2210 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLSVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2211 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYTPEYYIDNQILPAIQRIFEAIGYTRDYLKEGITQTSLSRWF

SEQ ID NO: 2212 - protein, 776 aa, synthetic construct
  REGION 1..776: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTR

SEQ ID NO: 2213 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKRELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2214 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEAEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 2215 - protein, 773 aa, unidentified
  REGION 1..773: note = Description of Unknown: Euryarchaeota archaeon sequence
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFDIETYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSLYPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2216 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYGASIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2217 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSSGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2218 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSAAGSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2219 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2220 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSSGASIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2221 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSSAGSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2222 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSSAPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2223 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAGSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2224 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSAGASIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2225 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSAAASIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2226 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYAGSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2227 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2228 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYAPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2229 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFGASIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2230 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSAGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2231 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2232 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2233 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSSAASIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2234 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSAAPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2235 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAASIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2236 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYAASIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2237 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLAPIVRRNVRLSSYVLENVVKEVLGREKEKIPHDAMAGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAPSIIVTHNIDPATLRPGRGENSPPELDYHFTTEEEGFIPSVLKRVLERRLSAKRRMKEARDPGEKRMLDISQRALKIIANSFYGYMGYPRARWYKKEAAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2238 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMVGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2239 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMVGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2240 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSAAPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVASFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2241 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYAPSIIVTHNIDPATLRPGRGENSPPELDYHFTTEEEGFIPSVLKRVLERRLSAKRRMKEARDPGEKRMLDISQRALKIIANSFYGYMGYPRARWYKKECAEAVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2242 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLAPIVRRNVRLSSYVLENVVKEVLGREKEKIPHDAMVGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2243 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSSAPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVASFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2244 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVASFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2245 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYAPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVASFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2246 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSAAPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2247 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2248 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLAPIVRRNVRLSSYVLENVVKEVLGREKEKIPHDAMAGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2249 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSSAPSIIVTHNIDPATLRPGRGENSPPELDYHFTTEEEGFIPSVLKRVLERRLSAKRRMKEARDPGEKRMLDISQRSLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2250 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFGPSIIVTHNIDPATLRPGRGENSPPELDYHFTTEEEGFIPSVLKRVLERRLSAKRRMKEARDPGEKRMLDISQRTLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2251 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLAPIVRRNVRLSSYVLENVVKEVLGREKEKIPHDAMVGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYGPSIIVTHNIDPATLRPGRGENSPPELDYHFTTEEEGFIPSVLKRVLERRLSAKRRMKEARDPGEKRMLDISQRALKIIANSFYGYMGYPRARWYKKEAAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2252 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSSAPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2253 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMAGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFGPSIIVTHNIDPATLRPGRGENSPPELDYHFTTEEEGFIPSVLKRVLERRLSAKRRMKEARDPGEKRMLDISQRALKIIANSFYGYMGYPRARWYKKEAAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2254 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSAAPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2255 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2256 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMAGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2257 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLAPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSLAPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2258 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSAAGSIIVTHNIDPATLRPGRGENSPPELDYHFTTEEEGFIPSVLKRVLERRLSAKRRMKEARDPGEKRMLDISQRVLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2259 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSSAASIIVTHNIDPATLRPGRGENSPPELDYHFTTEEEGFIPSVLKRVLERRLSAKRRMKEARDPGEKRMLDISQRALKIIANSFYGYMGYPRARWYKKECAEAVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2260 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAASIIVTHNIDPATLRPGRGENSPPELDYHFTTEEEGFIPSVLKRVLERRLSAKRRMKEARDPGEKRMLDISQRALKIIANSFYGYMGYPRARWYKKECAESVASFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2261 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSAAPSIIVTHNIDPATLRPGRGENSPPELDYHFTTEEEGFIPSVLKRVLERRLSAKRRMKEARDPGEKRMLDISQRLLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2262 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYGPSIIVTHNIDPATLRPGRGENSPPELDYHFTTEEEGFIPSVLKRVLERRLSAKRRMKEARDPGEKRMLDISQRSLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2263 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAGSIIVTHNIDPATLRPGRGENSPPELDYHFTTEEEGFIPSVLKRVLERRLSAKRRMKEARDPGEKRMLDISQRVLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2264 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSSAASIIVTHNIDPATLRPGRGENSPPELDYHFTTEEEGFIPSVLKRVLERRLSAKRRMKEARDPGEKRMLDISQRSLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2265 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAASIIVTHNIDPATLRPGRGENSPPELDYHFTTEEEGFIPSVLKRVLERRLSAKRRMKEARDPGEKRMLDISQRVLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2266 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSAAPSIIVTHNIDPATLRPGRGENSPPELDYHFTTEEEGFIPSVLKRVLERRLSAKRRMKEARDPGEKRMLDISQRALKIIANSFYGYMGYPRARWYKKECAEAVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2267 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLAPIVRRNVRLSSYVLENVVKEVLGREKEKIPHDAMAGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2268 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMVGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAPSIIVTHNIDPATLRPGRGENSPPELDYHFTTEEEGFIPSVLKRVLERRLSAKRRMKEARDPGEKRMLDISQRALKIIANSFYGYMGYPRARWYKKEAAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2269 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLAPIVRRNVRLSSYVLENVVKEVLGREKEKIPHDAMAGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2270 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMVGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFGPSIIVTHNIDPATLRPGRGENSPPELDYHFTTEEEGFIPSVLKRVLERRLSAKRRMKEARDPGEKRMLDISQRALKIIANSFYGYMGYPRARWYKKEAAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2271 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSAAGSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVASFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2272 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFGPSIIVTHNIDPATLRPGRGENSPPELDYHFTTEEEGFIPSVLKRVLERRLSAKRRMKEARDPGEKRMLDISQRVLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2273 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSSAPSIIVTHNIDPATLRPGRGENSPPELDYHFTTEEEGFIPSVLKRVLERRLSAKRRMKEARDPGEKRMLDISQRTLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2274 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMVGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAPSIIVTHNIDPATLRPGRGENSPPELDYHFTTEEEGFIPSVLKRVLERRLSAKRRMKEARDPGEKRMLDISQRALKIIANSFYGYMGYPRARWYKKEAAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2275 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAGSIIVTHNIDPATLRPGRGENSPPELDYHFTTEEEGFIPSVLKRVLERRLSAKRRMKEARDPGEKRMLDISQRLLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2276 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLAPIVRRNVRLSSYVLENVVKEVLGREKEKIPHDAMVGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2277 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYAPSIIVTHNIDPATLRPGRGENSPPELDYHFTTEEEGFIPSVLKRVLERRLSAKRRMKEARDPGEKRMLDISQRTLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2278 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2279 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLAPIVRRNVRLSSYVLENVVKEVLGREKEKIPHDAMAGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2280 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAGSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2281 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAEAVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2282 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLAPIVRRNVRLSSYVLENVVKEVLGREKEKIPHDAMVGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAPSIIVTHNIDPATLRPGRGENSPPELDYHFTTEEEGFIPSVLKRVLERRLSAKRRMKEARDPGEKRMLDISQRALKIIANSFYGYMGYPRARWYKKEAAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2283 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYGPSIIVTHNIDPATLRPGRGENSPPELDYHFTTEEEGFIPSVLKRVLERRLSAKRRMKEARDPGEKRMLDISQRLLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2284 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLAPIVRRNVRLSSYVLENVVKEVLGREKEKIPHDAMAGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFGPSIIVTHNIDPATLRPGRGENSPPELDYHFTTEEEGFIPSVLKRVLERRLSAKRRMKEARDPGEKRMLDISQRALKIIANSFYGYMGYPRARWYKKEAAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2285 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMAGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2286 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAGSIIVTHNIDPATLRPGRGENSPPELDYHFTTEEEGFIPSVLKRVLERRLSAKRRMKEARDPGEKRMLDISQRSLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2287 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMVGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYGPSIIVTHNIDPATLRPGRGENSPPELDYHFTTEEEGFIPSVLKRVLERRLSAKRRMKEARDPGEKRMLDISQRALKIIANSFYGYMGYPRARWYKKEAAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2288 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLAPIVRRNVRLSSYVLENVVKEVLGREKEKIPHDAMAGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYGPSIIVTHNIDPATLRPGRGENSPPELDYHFTTEEEGFIPSVLKRVLERRLSAKRRMKEARDPGEKRMLDISQRALKIIANSFYGYMGYPRARWYKKEAAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2289 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFGPSIIVTHNIDPATLRPGRGENSPPELDYHFTTEEEGFIPSVLKRVLERRLSAKRRMKEARDPGEKRMLDISQRSLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2290 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVASFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2291 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYGPSIIVTHNIDPATLRPGRGENSPPELDYHFTTEEEGFIPSVLKRVLERRLSAKRRMKEARDPGEKRMLDISQRVLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2292 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMAGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAPSIIVTHNIDPATLRPGRGENSPPELDYHFTTEEEGFIPSVLKRVLERRLSAKRRMKEARDPGEKRMLDISQRALKIIANSFYGYMGYPRARWYKKEAAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2293 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2294 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSSAASIIVTHNIDPATLRPGRGENSPPELDYHFTTEEEGFIPSVLKRVLERRLSAKRRMKEARDPGEKRMLDISQRALKIIANSFYGYMGYPRARWYKKECAESVASFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2295 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAGSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2296 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYAPSIIVTHNIDPATLRPGRGENSPPELDYHFTTEEEGFIPSVLKRVLERRLSAKRRMKEARDPGEKRMLDISQRLLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2297 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAGSIIVTHNIDPATLRPGRGENSPPELDYHFTTEEEGFIPSVLKRVLERRLSAKRRMKEARDPGEKRMLDISQRTLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2298 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSAAPSIIVTHNIDPATLRPGRGENSPPELDYHFTTEEEGFIPSVLKRVLERRLSAKRRMKEARDPGEKRMLDISQRTLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2299 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYAPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2300 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLAPIVRRNVRLSSYVLENVVKEVLGREKEKIPHDAMVGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYGPSIIVTHNIDPATLRPGRGENSPPELDYHFTTEEEGFIPSVLKRVLERRLSAKRRMKEARDPGEKRMLDISQRALKIIANSFYGYMGYPRARWYKKEAAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2301 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFGPSIIVTHNIDPATLRPGRGENSPPELDYHFTTEEEGFIPSVLKRVLERRLSAKRRMKEARDPGEKRMLDISQRLLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2302 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSSAASIIVTHNIDPATLRPGRGENSPPELDYHFTTEEEGFIPSVLKRVLERRLSAKRRMKEARDPGEKRMLDISQRLLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2303 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSAAPSIIVTHNIDPATLRPGRGENSPPELDYHFTTEEEGFIPSVLKRVLERRLSAKRRMKEARDPGEKRMLDISQRVLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2304 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMAGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFGPSIIVTHNIDPATLRPGRGENSPPELDYHFTTEEEGFIPSVLKRVLERRLSAKRRMKEARDPGEKRMLDISQRALKIIANSFYGYMGYPRARWYKKEAAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2305 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMVGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2306 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSAAPSIIVTHNIDPATLRPGRGENSPPELDYHFTTEEEGFIPSVLKRVLERRLSAKRRMKEARDPGEKRMLDISQRSLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2307 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMVGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFGPSIIVTHNIDPATLRPGRGENSPPELDYHFTTEEEGFIPSVLKRVLERRLSAKRRMKEARDPGEKRMLDISQRALKIIANSFYGYMGYPRARWYKKEAAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2308 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSSAPSIIVTHNIDPATLRPGRGENSPPELDYHFTTEEEGFIPSVLKRVLERRLSAKRRMKEARDPGEKRMLDISQRVLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2309 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAPSIIVTHNIDPATLRPGRGENSPPELDYHFTTEEEGFIPSVLKRVLERRLSAKRRMKEARDPGEKRMLDISQRALKIIANSFYGYMGYPRARWYKKECAEAVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2310 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMVGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2311 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSAAGSIIVTHNIDPATLRPGRGENSPPELDYHFTTEEEGFIPSVLKRVLERRLSAKRRMKEARDPGEKRMLDISQRLLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2312 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYAPSIIVTHNIDPATLRPGRGENSPPELDYHFTTEEEGFIPSVLKRVLERRLSAKRRMKEARDPGEKRMLDISQRVLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2313 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSSAASIIVTHNIDPATLRPGRGENSPPELDYHFTTEEEGFIPSVLKRVLERRLSAKRRMKEARDPGEKRMLDISQRTLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2314 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLAPIVRRNVRLSSYVLENVVKEVLGREKEKIPHDAMVGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAPSIIVTHNIDPATLRPGRGENSPPELDYHFTTEEEGFIPSVLKRVLERRLSAKRRMKEARDPGEKRMLDISQRALKIIANSFYGYMGYPRARWYKKEAAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2315 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLAPIVRRNVRLSSYVLENVVKEVLGREKEKIPHDAMVGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFGPSIIVTHNIDPATLRPGRGENSPPELDYHFTTEEEGFIPSVLKRVLERRLSAKRRMKEARDPGEKRMLDISQRALKIIANSFYGYMGYPRARWYKKEAAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2316 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLAPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2317 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSSAASIIVTHNIDPATLRPGRGENSPPELDYHFTTEEEGFIPSVLKRVLERRLSAKRRMKEARDPGEKRMLDISQRVLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2318 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLAPIVRRNVRLSSYVLENVVKEVLGREKEKIPHDAMVGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2319 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMVGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYGPSIIVTHNIDPATLRPGRGENSPPELDYHFTTEEEGFIPSVLKRVLERRLSAKRRMKEARDPGEKRMLDISQRALKIIANSFYGYMGYPRARWYKKEAAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2320 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMAGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYGPSIIVTHNIDPATLRPGRGENSPPELDYHFTTEEEGFIPSVLKRVLERRLSAKRRMKEARDPGEKRMLDISQRALKIIANSFYGYMGYPRARWYKKEAAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2321 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAPSIIVTHNIDPATLRPGRGENSPPELDYHFTTEEEGFIPSVLKRVLERRLSAKRRMKEARDPGEKRMLDISQRTLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2322 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAGSIIVTHNIDPATLRPGRGENSPPELDYHFTTEEEGFIPSVLKRVLERRLSAKRRMKEARDPGEKRMLDISQRALKIIANSFYGYMGYPRARWYKKECAEAVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2323 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAEAVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2324 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAASIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2325 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLAPIVRRNVRLSSYVLENVVKEVLGREKEKIPHDAMVGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2326 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAPSIIVTHNIDPATLRPGRGENSPPELDYHFTTEEEGFIPSVLKRVLERRLSAKRRMKEARDPGEKRMLDISQRVLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2327 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMVGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2328 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYAPSIIVTHNIDPATLRPGRGENSPPELDYHFTTEEEGFIPSVLKRVLERRLSAKRRMKEARDPGEKRMLDISQRSLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2329 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMAGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYGPSIIVTHNIDPATLRPGRGENSPPELDYHFTTEEEGFIPSVLKRVLERRLSAKRRMKEARDPGEKRMLDISQRALKIIANSFYGYMGYPRARWYKKEAAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2330 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYAPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2331 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYAGSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2332 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAASIIVTHNIDPATLRPGRGENSPPELDYHFTTEEEGFIPSVLKRVLERRLSAKRRMKEARDPGEKRMLDISQRLLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2333 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLAPIVRRNVRLSSYVLENVVKEVLGREKEKIPHDAMVGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2334 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLAPIVRRNVRLSSYVLENVVKEVLGREKEKIPHDAMAGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2335 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSSAASIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2336 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMAGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2337 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSSAPSIIVTHNIDPATLRPGRGENSPPELDYHFTTEEEGFIPSVLKRVLERRLSAKRRMKEARDPGEKRMLDISQRLLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2338 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2339 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMAGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2340 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLAPIVRRNVRLSSYVLENVVKEVLGREKEKIPHDAMAGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYGPSIIVTHNIDPATLRPGRGENSPPELDYHFTTEEEGFIPSVLKRVLERRLSAKRRMKEARDPGEKRMLDISQRALKIIANSFYGYMGYPRARWYKKEAAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2341 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSAAGSIIVTHNIDPATLRPGRGENSPPELDYHFTTEEEGFIPSVLKRVLERRLSAKRRMKEARDPGEKRMLDISQRALKIIANSFYGYMGYPRARWYKKECAEAVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2342 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSAAGSIIVTHNIDPATLRPGRGENSPPELDYHFTTEEEGFIPSVLKRVLERRLSAKRRMKEARDPGEKRMLDISQRTLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2343 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSAAGSIIVTHNIDPATLRPGRGENSPPELDYHFTTEEEGFIPSVLKRVLERRLSAKRRMKEARDPGEKRMLDISQRSLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2344 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLAPIVRRNVRLSSYVLENVVKEVLGREKEKIPHDAMAGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAPSIIVTHNIDPATLRPGRGENSPPELDYHFTTEEEGFIPSVLKRVLERRLSAKRRMKEARDPGEKRMLDISQRALKIIANSFYGYMGYPRARWYKKEAAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2345 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLAPIVRRNVRLSSYVLENVVKEVLGREKEKIPHDAMAGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2346 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLAPIVRRNVRLSSYVLENVVKEVLGREKEKIPHDAMAGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFGPSIIVTHNIDPATLRPGRGENSPPELDYHFTTEEEGFIPSVLKRVLERRLSAKRRMKEARDPGEKRMLDISQRALKIIANSFYGYMGYPRARWYKKEAAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2347 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLAPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2348 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMVGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2349 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVASFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2350 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAGSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVASFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2351 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSAAGSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2352 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAASIIVTHNIDPATLRPGRGENSPPELDYHFTTEEEGFIPSVLKRVLERRLSAKRRMKEARDPGEKRMLDISQRSLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2353 - protein, 773 aa, synthetic construct; identical to SEQ ID NO: 2299
  REGION 1..773: note = Description of Artificial Sequence: Synthetic polypeptide

SEQ ID NO: 2354 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSAAGSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2355 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAASIIVTHNIDPATLRPGRGENSPPELDYHFTTEEEGFIPSVLKRVLERRLSAKRRMKEARDPGEKRMLDISQRALKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2356 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMAGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAPSIIVTHNIDPATLRPGRGENSPPELDYHFTTEEEGFIPSVLKRVLERRLSAKRRMKEARDPGEKRMLDISQRALKIIANSFYGYMGYPRARWYKKEAAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2357 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAASIIVTHNIDPATLRPGRGENSPPELDYHFTTEEEGFIPSVLKRVLERRLSAKRRMKEARDPGEKRMLDISQRALKIIANSFYGYMGYPRARWYKKECAEAVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2358 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLAPIVRRNVRLSSYVLENVVKEVLGREKEKIPHDAMVGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2359 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMAGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2360 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLAPIVRRNVRLSSYVLENVVKEVLGREKEKIPHDAMVGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFGPSIIVTHNIDPATLRPGRGENSPPELDYHFTTEEEGFIPSVLKRVLERRLSAKRRMKEARDPGEKRMLDISQRALKIIANSFYGYMGYPRARWYKKEAAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2361 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSSAPSIIVTHNIDPATLRPGRGENSPPELDYHFTTEEEGFIPSVLKRVLERRLSAKRRMKEARDPGEKRMLDISQRALKIIANSFYGYMGYPRARWYKKECAEAVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2362 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAPSIIVTHNIDPATLRPGRGENSPPELDYHFTTEEEGFIPSVLKRVLERRLSAKRRMKEARDPGEKRMLDISQRLLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2363 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAASIIVTHNIDPATLRPGRGENSPPELDYHFTTEEEGFIPSVLKRVLERRLSAKRRMKEARDPGEKRMLDISQRTLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2364 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSYGPSIIVTHNIDPATLRPGRGENSPPELDYHFTTEEEGFIPSVLKRVLERRLSAKRRMKEARDPGEKRMLDISQRTLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2365 - protein, 773 aa, synthetic construct
  REGION 1..773: note = Description of Artificial Sequence: Synthetic polypeptide
MARDLLLDIDFVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMAGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFGPSIIVTHNIDPATLRPGRGENSPPELDYHFTTEEEGFIPSVLKRVLERRLSAKRRMKEARDPGEKRMLDISQRALKIIANSFYGYMGYPRARWYKKECAESVSSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2366 - protein, 773 aa, synthetic construct
  REGION 1..773: note = Description of Artificial Sequence: Synthetic polypeptide
MARDLLLDIDYVTVDEKAQVRLFLKDKILFDPGFQPYFYVLAHDGAVEERLRDFGAVEAVQRRMLGREMRFFKLILSHPSEVPKIREEVRSIEGVEGIFEHDILFARRYLIDKGLTPLNYAEYRAEQGFLKGISSAGEGPESLRVMAFAIATYNPKGAPRAEKDPVIMLSLSTNTGLRRLLTYKSGEGLDFVELVEDEKALLHRFKELVNEEGVEVLVGYNSDQFDLPYLVARAKALGVELPLGQDGSQPQIRKGRGLVESVVKGRPHVDLYPIVRRNVRLSSYVLENVVKEVLGREKEKIPHDAMCGYWDRGGRELQRFMAYSMEDADVTLELAERFLPLYIELSRVVGLPLHDVARMTAGQLVEWLLIREAFARGEVVPNKGSGREYLARSEDTYAGGYVMEPVKGIVENIVVFDFRSFAPSIIVTHNIDPATLRPGRGENSPPELDYHFTTEEEGFIPSVLKRVLERRLSAKRRMKEARDPGEKRMLDISQRSLKIIANSFYGYMGYPRARWYKKECAESVTSFARMYTKKVMAIAEEEYGFKVVYGDTDSLFIVVQPEEKERAMSFMEDVNRRLPGTVELEYDGFYPRGIFITKKRYALIDEKGNIVVKGLETVRRDWTRLSRDTQQKVLSVILREGDPKKAADIVKDTINRLKERRVDLEDITIYTQLTKGIGRYKNVGPHVKAAQKAIDRGREVNPGMAIGYIIKKGRGLISDRAEPVEDATIEDYDVDYYIENQVLPPVARIMEVLGYSKEHLKEEMVQGSLQRWF

SEQ ID NO: 2367 - protein, 809 aa, unidentified
  REGION 1..809: note = Description of Unknown: Hadesarchaea archaeon sequence
MRGLLFDVDIAEEEERPNVRLFVKVASETVVAIDPQFEEYFYVVADHPAKTSKLIEKIELDEGGRPIRPKSVEMVRRTLLGNEVEAIRVSFHQPRDAAKLRHKIRELPGVKEIYEFDIPPARRYLIDRGLTPMAGIEFSGSIEVRDGVKTVVMDGPPKPAPVEETRLNIMSFDIEVYNPTGSVRPDKDPIIMISLADNRGLRKVITWKNFDKKPEYVEVVGSEREMIKKFVELVKERDVDILLGYNTDLFDLPYIRSRAKQLRVKLDLGRDGSELVVRKRRFATASKIRGRVHVDVFAMVDFLATIGSIRLIHYSLADVYRHYAGREKPDFEFSEMINAWERGGDAGRRFLEYSMSDADATLEVGSELLPLFLGLTRVVGQTLFDVQRMTPGQLVEWLLVAEAHRIGELVPPRPVGEEFEERAEGTFTGAYVMEPVKGLHEDLVVFDFRSLYPSIIVTHNIDPSTLNCRDCKPGEREQVPGLSYYFCKRRKGFIPAVLERVIEERTKLKAELKKIGRETREYRALDARQWAMKIVANSFYGMLGYPRARWYSKQCAESVTSFGRHYIHRTIEMAREFGLEVVYGDTDSLHCKLNGKTREEAMVFLRKVNESLPGIMELELEGFYPRGIFITKKRYAMVDDEGRMVVKGLEFVRRDWAAIAKKTQEEVLRAILRDGSPKKAAEIIRKTTRDVYEGRVNLEDLIIYTQLKMPIESYKAIGPHVVAAKRLRELGHEIEPGMMIAYIEVKGPGSISDRAVPVEDFEGKEYDPDYYVGHQILPAVMRIMEVLGYSEEDLKFEREKQIGLDRFMK

SEQ ID NO: 2368 - protein, 809 aa, synthetic construct
  REGION 1..809: note = Description of Artificial Sequence: Synthetic polypeptide
MRGLLFDVDIAEEEERPNVRLFVKVASETVVAIDPQFEEYFYVVADHPAKTSKLIEKIELDEGGRPIRPKSVEMVRRTLLGNEVEAIRVSFHQPRDAAKLRHKIRELPGVKEIYEFDIPPARRYLIDRGLTPMAGIEFSGSIEVRDGVKTVVMDGPPKPAPVEETRLNIMSFAIAVYNPTGSVRPDKDPIIMISLADNRGLRKVITWKNFDKKPEYVEVVGSEREMIKKFVELVKERDVDILLGYNTDLFDLPYIRSRAKQLRVKLDLGRDGSELVVRKRRFATASKIRGRVHVDVFAMVDFLATIGSIRLIHYSLADVYRHYAGREKPDFEFSEMINAWERGGDAGRRFLEYSMSDADATLEVGSELLPLFLGLTRVVGQTLFDVQRMTPGQLVEWLLVAEAHRIGELVPPRPVGEEFEERAEGTFTGAYVMEPVKGLHEDLVVFDFRSFGPSIIVTHNIDPSTLNCRDCKPGEREQVPGLSYYFCKRRKGFIPAVLERVIEERTKLKAELKKIGRETREYRALDARQWAMKIVANSFYGMLGYPRARWYSKQCAESVTSFGRHYIHRTIEMAREFGLEVVYGDTDSLHCKLNGKTREEAMVFLRKVNESLPGIMELELEGFYPRGIFITKKRYAMVDDEGRMVVKGLEFVRRDWAAIAKKTQEEVLRAILRDGSPKKAAEIIRKTTRDVYEGRVNLEDLIIYTQLKMPIESYKAIGPHVVAAKRLRELGHEIEPGMMIAYIEVKGPGSISDRAVPVEDFEGKEYDPDYYVGHQILPAVMRIMEVLGYSEEDLKFEREKQIGLDRFMK

SEQ ID NO: 2369 - protein, 809 aa, synthetic construct
  REGION 1..809: note = Description of Artificial Sequence: Synthetic polypeptide
MRGLLFDVDIAEEEERPNVRLFVKVASETVVAIDPQFEEYFYVVADHPAKTSKLIEKIELDEGGRPIRPKSVEMVRRTLLGNEVEAIRVSFHQPRDAAKLRHKIRELPGVKEIYEFDIPPARRYLIDRGLTPMAGIEFSGSIEVRDGVKTVVMDGPPKPAPVEETRLNIMSFAIAVYNPTGSVRPDKDPIIMISLADNRGLRKVITWKNFDKKPEYVEVVGSEREMIKKFVELVKERDVDILLGYNTDLFDLPYIRSRAKQLRVKLDLGRDGSELVVRKRRFATASKIRGRVHVDVFAMVDFLATIGSIRLIHYSLADVYRHYAGREKPDFEFSEMINAWERGGDAGRRFLEYSMSDADATLEVGSELLPLFLGLTRVVGQTLFDVQRMTPGQLVEWLLVAEAHRIGELVPPRPVGEEFEERAEGTFTGAYVMEPVKGLHEDLVVFDFRSFAGSIIVTHNIDPSTLNCRDCKPGEREQVPGLSYYFCKRRKGFIPAVLERVIEERTKLKAELKKIGRETREYRALDARQWAMKIVANSFYGMLGYPRARWYSKQCAESVTSFGRHYIHRTIEMAREFGLEVVYGDTDSLHCKLNGKTREEAMVFLRKVNESLPGIMELELEGFYPRGIFITKKRYAMVDDEGRMVVKGLEFVRRDWAAIAKKTQEEVLRAILRDGSPKKAAEIIRKTTRDVYEGRVNLEDLIIYTQLKMPIESYKAIGPHVVAAKRLRELGHEIEPGMMIAYIEVKGPGSISDRAVPVEDFEGKEYDPDYYVGHQILPAVMRIMEVLGYSEEDLKFEREKQIGLDRFMK

SEQ ID NO: 2370 - protein, 809 aa, synthetic construct
  REGION 1..809: note = Description of Artificial Sequence: Synthetic polypeptide
MRGLLFDVDIAEEEERPNVRLFVKVASETVVAIDPQFEEYFYVVADHPAKTSKLIEKIELDEGGRPIRPKSVEMVRRTLLGNEVEAIRVSFHQPRDAAKLRHKIRELPGVKEIYEFDIPPARRYLIDRGLTPMAGIEFSGSIEVRDGVKTVVMDGPPKPAPVEETRLNIMSFAIAVYNPTGSVRPDKDPIIMISLADNRGLRKVITWKNFDKKPEYVEVVGSEREMIKKFVELVKERDVDILLGYNTDLFDLPYIRSRAKQLRVKLDLGRDGSELVVRKRRFATASKIRGRVHVDVFAMVDFLATIGSIRLIHYSLADVYRHYAGREKPDFEFSEMINAWERGGDAGRRFLEYSMSDADATLEVGSELLPLFLGLTRVVGQTLFDVQRMTPGQLVEWLLVAEAHRIGELVPPRPVGEEFEERAEGTFTGAYVMEPVKGLHEDLVVFDFRSSAGSIIVTHNIDPSTLNCRDCKPGEREQVPGLSYYFCKRRKGFIPAVLERVIEERTKLKAELKKIGRETREYRALDARQWAMKIVANSFYGMLGYPRARWYSKQCAESVTSFGRHYIHRTIEMAREFGLEVVYGDTDSLHCKLNGKTREEAMVFLRKVNESLPGIMELELEGFYPRGIFITKKRYAMVDDEGRMVVKGLEFVRRDWAAIAKKTQEEVLRAILRDGSPKKAAEIIRKTTRDVYEGRVNLEDLIIYTQLKMPIESYKAIGPHVVAAKRLRELGHEIEPGMMIAYIEVKGPGSISDRAVPVEDFEGKEYDPDYYVGHQILPAVMRIMEVLGYSEEDLKFEREKQIGLDRFMK

SEQ ID NO: 2371 - protein, 809 aa, synthetic construct
  REGION 1..809: note = Description of Artificial Sequence: Synthetic polypeptide
MRGLLFDVDIAEEEERPNVRLFVKVASETVVAIDPQFEEYFYVVADHPAKTSKLIEKIELDEGGRPIRPKSVEMVRRTLLGNEVEAIRVSFHQPRDAAKLRHKIRELPGVKEIYEFDIPPARRYLIDRGLTPMAGIEFSGSIEVRDGVKTVVMDGPPKPAPVEETRLNIMSFAIAVYNPTGSVRPDKDPIIMISLADNRGLRKVITWKNFDKKPEYVEVVGSEREMIKKFVELVKERDVDILLGYNTDLFDLPYIRSRAKQLRVKLDLGRDGSELVVRKRRFATASKIRGRVHVDVFAMVDFLATIGSIRLIHYSLADVYRHYAGREKPDFEFSEMINAWERGGDAGRRFLEYSMSDADATLEVGSELLPLFLGLTRVVGQTLFDVQRMTPGQLVEWLLVAEAHRIGELVPPRPVGEEFEERAEGTFTGAYVMEPVKGLHEDLVVFDFRSSAPSIIVTHNIDPSTLNCRDCKPGEREQVPGLSYYFCKRRKGFIPAVLERVIEERTKLKAELKKIGRETREYRALDARQWAMKIVANSFYGMLGYPRARWYSKQCAESVTSFGRHYIHRTIEMAREFGLEVVYGDTDSLHCKLNGKTREEAMVFLRKVNESLPGIMELELEGFYPRGIFITKKRYAMVDDEGRMVVKGLEFVRRDWAAIAKKTQEEVLRAILRDGSPKKAAEIIRKTTRDVYEGRVNLEDLIIYTQLKMPIESYKAIGPHVVAAKRLRELGHEIEPGMMIAYIEVKGPGSISDRAVPVEDFEGKEYDPDYYVGHQILPAVMRIMEVLGYSEEDLKFEREKQIGLDRFMK

SEQ ID NO: 2372 - protein, 809 aa, synthetic construct
  REGION 1..809: note = Description of Artificial Sequence: Synthetic polypeptide
MRGLLFDVDIAEEEERPNVRLFVKVASETVVAIDPQFEEYFYVVADHPAKTSKLIEKIELDEGGRPIRPKSVEMVRRTLLGNEVEAIRVSFHQPRDAAKLRHKIRELPGVKEIYEFDIPPARRYLIDRGLTPMAGIEFSGSIEVRDGVKTVVMDGPPKPAPVEETRLNIMSFAIAVYNPTGSVRPDKDPIIMISLADNRGLRKVITWKNFDKKPEYVEVVGSEREMIKKFVELVKERDVDILLGYNTDLFDLPYIRSRAKQLRVKLDLGRDGSELVVRKRRFATASKIRGRVHVDVFAMVDFLATIGSIRLIHYSLADVYRHYAGREKPDFEFSEMINAWERGGDAGRRFLEYSMSDADATLEVGSELLPLFLGLTRVVGQTLFDVQRMTPGQLVEWLLVAEAHRIGELVPPRPVGEEFEERAEGTFTGAYVMEPVKGLHEDLVVFDFRSSGASIIVTHNIDPSTLNCRDCKPGEREQVPGLSYYFCKRRKGFIPAVLERVIEERTKLKAELKKIGRETREYRALDARQWAMKIVANSFYGMLGYPRARWYSKQCAESVTSFGRHYIHRTIEMAREFGLEVVYGDTDSLHCKLNGKTREEAMVFLRKVNESLPGIMELELEGFYPRGIFITKKRYAMVDDEGRMVVKGLEFVRRDWAAIAKKTQEEVLRAILRDGSPKKAAEIIRKTTRDVYEGRVNLEDLIIYTQLKMPIESYKAIGPHVVAAKRLRELGHEIEPGMMIAYIEVKGPGSISDRAVPVEDFEGKEYDPDYYVGHQILPAVMRIMEVLGYSEEDLKFEREKQIGLDRFMK

SEQ ID NO: 2373 - protein, 809 aa, synthetic construct
  REGION 1..809: note = Description of Artificial Sequence: Synthetic polypeptide
MRGLLFDVDIAEEEERPNVRLFVKVASETVVAIDPQFEEYFYVVADHPAKTSKLIEKIELDEGGRPIRPKSVEMVRRTLLGNEVEAIRVSFHQPRDAAKLRHKIRELPGVKEIYEFDIPPARRYLIDRGLTPMAGIEFSGSIEVRDGVKTVVMDGPPKPAPVEETRLNIMSFAIAVYNPTGSVRPDKDPIIMISLADNRGLRKVITWKNFDKKPEYVEVVGSEREMIKKFVELVKERDVDILLGYNTDLFDLPYIRSRAKQLRVKLDLGRDGSELVVRKRRFATASKIRGRVHVDVFAMVDFLATIGSIRLIHYSLADVYRHYAGREKPDFEFSEMINAWERGGDAGRRFLEYSMSDADATLEVGSELLPLFLGLTRVVGQTLFDVQRMTPGQLVEWLLVAEAHRIGELVPPRPVGEEFEERAEGTFTGAYVMEPVKGLHEDLVVFDFRSYGASIIVTHNIDPSTLNCRDCKPGEREQVPGLSYYFCKRRKGFIPAVLERVIEERTKLKAELKKIGRETREYRALDARQWAMKIVANSFYGMLGYPRARWYSKQCAESVTSFGRHYIHRTIEMAREFGLEVVYGDTDSLHCKLNGKTREEAMVFLRKVNESLPGIMELELEGFYPRGIFITKKRYAMVDDEGRMVVKGLEFVRRDWAAIAKKTQEEVLRAILRDGSPKKAAEIIRKTTRDVYEGRVNLEDLIIYTQLKMPIESYKAIGPHVVAAKRLRELGHEIEPGMMIAYIEVKGPGSISDRAVPVEDFEGKEYDPDYYVGHQILPAVMRIMEVLGYSEEDLKFEREKQIGLDRFMK

SEQ ID NO: 2374 - protein, 809 aa, synthetic construct
  REGION 1..809: note = Description of Artificial Sequence: Synthetic polypeptide
MRGLLFDVDIAEEEERPNVRLFVKVASETVVAIDPQFEEYFYVVADHPAKTSKLIEKIELDEGGRPIRPKSVEMVRRTLLGNEVEAIRVSFHQPRDAAKLRHKIRELPGVKEIYEFDIPPARRYLIDRGLTPMAGIEFSGSIEVRDGVKTVVMDGPPKPAPVEETRLNIMSFAIAVYNPTGSVRPDKDPIIMISLADNRGLRKVITWKNFDKKPEYVEVVGSEREMIKKFVELVKERDVDILLGYNTDLFDLPYIRSRAKQLRVKLDLGRDGSELVVRKRRFATASKIRGRVHVDVFAMVDFLATIGSIRLIHYSLADVYRHYAGREKPDFEFSEMINAWERGGDAGRRFLEYSMSDADATLEVGSELLPLFLGLTRVVGQTLFDVQRMTPGQLVEWLLVAEAHRIGELVPPRPVGEEFEERAEGTFTGAYVMEPVKGLHEDLVVFDFRSYAGSIIVTHNIDPSTLNCRDCKPGEREQVPGLSYYFCKRRKGFIPAVLERVIEERTKLKAELKKIGRETREYRALDARQWAMKIVANSFYGMLGYPRARWYSKQCAESVTSFGRHYIHRTIEMAREFGLEVVYGDTDSLHCKLNGKTREEAMVFLRKVNESLPGIMELELEGFYPRGIFITKKRYAMVDDEGRMVVKGLEFVRRDWAAIAKKTQEEVLRAILRDGSPKKAAEIIRKTTRDVYEGRVNLEDLIIYTQLKMPIESYKAIGPHVVAAKRLRELGHEIEPGMMIAYIEVKGPGSISDRAVPVEDFEGKEYDPDYYVGHQILPAVMRIMEVLGYSEEDLKFEREKQIGLDRFMK

SEQ ID NO: 2375 - protein, 809 aa, synthetic construct
  REGION 1..809: note = Description of Artificial Sequence: Synthetic polypeptide
MRGLLFDVDIAEEEERPNVRLFVKVASETVVAIDPQFEEYFYVVADHPAKTSKLIEKIELDEGGRPIRPKSVEMVRRTLLGNEVEAIRVSFHQPRDAAKLRHKIRELPGVKEIYEFDIPPARRYLIDRGLTPMAGIEFSGSIEVRDGVKTVVMDGPPKPAPVEETRLNIMSFAIAVYNPTGSVRPDKDPIIMISLADNRGLRKVITWKNFDKKPEYVEVVGSEREMIKKFVELVKERDVDILLGYNTDLFDLPYIRSRAKQLRVKLDLGRDGSELVVRKRRFATASKIRGRVHVDVFAMVDFLATIGSIRLIHYSLADVYRHYAGREKPDFEFSEMINAWERGGDAGRRFLEYSMSDADATLEVGSELLPLFLGLTRVVGQTLFDVQRMTPGQLVEWLLVAEAHRIGELVPPRPVGEEFEERAEGTFTGAYVMEPVKGLHEDLVVFDFRSFGASIIVTHNIDPSTLNCRDCKPGEREQVPGLSYYFCKRRKGFIPAVLERVIEERTKLKAELKKIGRETREYRALDARQWAMKIVANSFYGMLGYPRARWYSKQCAESVTSFGRHYIHRTIEMAREFGLEVVYGDTDSLHCKLNGKTREEAMVFLRKVNESLPGIMELELEGFYPRGIFITKKRYAMVDDEGRMVVKGLEFVRRDWAAIAKKTQEEVLRAILRDGSPKKAAEIIRKTTRDVYEGRVNLEDLIIYTQLKMPIESYKAIGPHVVAAKRLRELGHEIEPGMMIAYIEVKGPGSISDRAVPVEDFEGKEYDPDYYVGHQILPAVMRIMEVLGYSEEDLKFEREKQIGLDRFMK

SEQ ID NO: 2376 - protein, 809 aa, synthetic construct
  REGION 1..809: note = Description of Artificial Sequence: Synthetic polypeptide
MRGLLFDVDIAEEEERPNVRLFVKVASETVVAIDPQFEEYFYVVADHPAKTSKLIEKIELDEGGRPIRPKSVEMVRRTLLGNEVEAIRVSFHQPRDAAKLRHKIRELPGVKEIYEFDIPPARRYLIDRGLTPMAGIEFSGSIEVRDGVKTVVMDGPPKPAPVEETRLNIMSFAIAVYNPTGSVRPDKDPIIMISLADNRGLRKVITWKNFDKKPEYVEVVGSEREMIKKFVELVKERDVDILLGYNTDLFDLPYIRSRAKQLRVKLDLGRDGSELVVRKRRFATASKIRGRVHVDVFAMVDFLATIGSIRLIHYSLADVYRHYAGREKPDFEFSEMINAWERGGDAGRRFLEYSMSDADATLEVGSELLPLFLGLTRVVGQTLFDVQRMTPGQLVEWLLVAEAHRIGELVPPRPVGEEFEERAEGTFTGAYVMEPVKGLHEDLVVFDFRSAAASIIVTHNIDPSTLNCRDCKPGEREQVPGLSYYFCKRRKGFIPAVLERVIEERTKLKAELKKIGRETREYRALDARQWAMKIVANSFYGMLGYPRARWYSKQCAESVTSFGRHYIHRTIEMAREFGLEVVYGDTDSLHCKLNGKTREEAMVFLRKVNESLPGIMELELEGFYPRGIFITKKRYAMVDDEGRMVVKGLEFVRRDWAAIAKKTQEEVLRAILRDGSPKKAAEIIRKTTRDVYEGRVNLEDLIIYTQLKMPIESYKAIGPHVVAAKRLRELGHEIEPGMMIAYIEVKGPGSISDRAVPVEDFEGKEYDPDYYVGHQILPAVMRIMEVLGYSEEDLKFEREKQIGLDRFMK

SEQ ID NO: 2377 - protein, 809 aa, synthetic construct
  REGION 1..809: note = Description of Artificial Sequence: Synthetic polypeptide
MRGLLFDVDIAEEEERPNVRLFVKVASETVVAIDPQFEEYFYVVADHPAKTSKLIEKIELDEGGRPIRPKSVEMVRRTLLGNEVEAIRVSFHQPRDAAKLRHKIRELPGVKEIYEFDIPPARRYLIDRGLTPMAGIEFSGSIEVRDGVKTVVMDGPPKPAPVEETRLNIMSFAIAVYNPTGSVRPDKDPIIMISLADNRGLRKVITWKNFDKKPEYVEVVGSEREMIKKFVELVKERDVDILLGYNTDLFDLPYIRSRAKQLRVKLDLGRDGSELVVRKRRFATASKIRGRVHVDVFAMVDFLATIGSIRLIHYSLADVYRHYAGREKPDFEFSEMINAWERGGDAGRRFLEYSMSDADATLEVGSELLPLFLGLTRVVGQTLFDVQRMTPGQLVEWLLVAEAHRIGELVPPRPVGEEFEERAEGTFTGAYVMEPVKGLHEDLVVFDFRSSGPSIIVTHNIDPSTLNCRDCKPGEREQVPGLSYYFCKRRKGFIPAVLERVIEERTKLKAELKKIGRETREYRALDARQWAMKIVANSFYGMLGYPRARWYSKQCAESVTSFGRHYIHRTIEMAREFGLEVVYGDTDSLHCKLNGKTREEAMVFLRKVNESLPGIMELELEGFYPRGIFITKKRYAMVDDEGRMVVKGLEFVRRDWAAIAKKTQEEVLRAILRDGSPKKAAEIIRKTTRDVYEGRVNLEDLIIYTQLKMPIESYKAIGPHVVAAKRLRELGHEIEPGMMIAYIEVKGPGSISDRAVPVEDFEGKEYDPDYYVGHQILPAVMRIMEVLGYSEEDLKFEREKQIGLDRFMK

SEQ ID NO: 2378 - protein, 809 aa, synthetic construct
  REGION 1..809: note = Description of Artificial Sequence: Synthetic polypeptide
MRGLLFDVDIAEEEERPNVRLFVKVASETVVAIDPQFEEYFYVVADHPAKTSKLIEKIELDEGGRPIRPKSVEMVRRTLLGNEVEAIRVSFHQPRDAAKLRHKIRELPGVKEIYEFDIPPARRYLIDRGLTPMAGIEFSGSIEVRDGVKTVVMDGPPKPAPVEETRLNIMSFAIAVYNPTGSVRPDKDPIIMISLADNRGLRKVITWKNFDKKPEYVEVVGSEREMIKKFVELVKERDVDILLGYNTDLFDLPYIRSRAKQLRVKLDLGRDGSELVVRKRRFATASKIRGRVHVDVFAMVDFLATIGSIRLIHYSLADVYRHYAGREKPDFEFSEMINAWERGGDAGRRFLEYSMSDADATLEVGSELLPLFLGLTRVVGQTLFDVQRMTPGQLVEWLLVAEAHRIGELVPPRPVGEEFEERAEGTFTGAYVMEPVKGLHEDLVVFDFRSAAGSIIVTHNIDPSTLNCRDCKPGEREQVPGLSYYFCKRRKGFIPAVLERVIEERTKLKAELKKIGRETREYRALDARQWAMKIVANSFYGMLGYPRARWYSKQCAESVTSFGRHYIHRTIEMAREFGLEVVYGDTDSLHCKLNGKTREEAMVFLRKVNESLPGIMELELEGFYPRGIFITKKRYAMVDDEGRMVVKGLEFVRRDWAAIAKKTQEEVLRAILRDGSPKKAAEIIRKTTRDVYEGRVNLEDLIIYTQLKMPIESYKAIGPHVVAAKRLRELGHEIEPGMMIAYIEVKGPGSISDRAVPVEDFEGKEYDPDYYVGHQILPAVMRIMEVLGYSEEDLKFEREKQIGLDRFMK

SEQ ID NO: 2379 - protein, 809 aa, synthetic construct
  REGION 1..809: note = Description of Artificial Sequence: Synthetic polypeptide
MRGLLFDVDIAEEEERPNVRLFVKVASETVVAIDPQFEEYFYVVADHPAKTSKLIEKIELDEGGRPIRPKSVEMVRRTLLGNEVEAIRVSFHQPRDAAKLRHKIRELPGVKEIYEFDIPPARRYLIDRGLTPMAGIEFSGSIEVRDGVKTVVMDGPPKPAPVEETRLNIMSFAIAVYNPTGSVRPDKDPIIMISLADNRGLRKVITWKNFDKKPEYVEVVGSEREMIKKFVELVKERDVDILLGYNTDLFDLPYIRSRAKQLRVKLDLGRDGSELVVRKRRFATASKIRGRVHVDVFAMVDFLATIGSIRLIHYSLADVYRHYAGREKPDFEFSEMINAWERGGDAGRRFLEYSMSDADATLEVGSELLPLFLGLTRVVGQTLFDVQRMTPGQLVEWLLVAEAHRIGELVPPRPVGEEFEERAEGTFTGAYVMEPVKGLHEDLVVFDFRSAGPSIIVTHNIDPSTLNCRDCKPGEREQVPGLSYYFCKRRKGFIPAVLERVIEERTKLKAELKKIGRETREYRALDARQWAMKIVANSFYGMLGYPRARWYSKQCAESVTSFGRHYIHRTIEMAREFGLEVVYGDTDSLHCKLNGKTREEAMVFLRKVNESLPGIMELELEGFYPRGIFITKKRYAMVDDEGRMVVKGLEFVRRDWAAIAKKTQEEVLRAILRDGSPKKAAEIIRKTTRDVYEGRVNLEDLIIYTQLKMPIESYKAIGPHVVAAKRLRELGHEIEPGMMIAYIEVKGPGSISDRAVPVEDFEGKEYDPDYYVGHQILPAVMRIMEVLGYSEEDLKFEREKQIGLDRFMK

SEQ ID NO: 2380 - protein, 809 aa, synthetic construct
  REGION 1..809: note = Description of Artificial Sequence: Synthetic polypeptide
MRGLLFDVDIAEEEERPNVRLFVKVASETVVAIDPQFEEYFYVVADHPAKTSKLIEKIELDEGGRPIRPKSVEMVRRTLLGNEVEAIRVSFHQPRDAAKLRHKIRELPGVKEIYEFDIPPARRYLIDRGLTPMAGIEFSGSIEVRDGVKTVVMDGPPKPAPVEETRLNIMSFAIAVYNPTGSVRPDKDPIIMISLADNRGLRKVITWKNFDKKPEYVEVVGSEREMIKKFVELVKERDVDILLGYNTDLFDLPYIRSRAKQLRVKLDLGRDGSELVVRKRRFATASKIRGRVHVDVFAMVDFLATIGSIRLIHYSLADVYRHYAGREKPDFEFSEMINAWERGGDAGRRFLEYSMSDADATLEVGSELLPLFLGLTRVVGQTLFDVQRMTPGQLVEWLLVAEAHRIGELVPPRPVGEEFEERAEGTFTGAYVMEPVKGLHEDLVVFDFRSAGASIIVTHNIDPSTLNCRDCKPGEREQVPGLSYYFCKRRKGFIPAVLERVIEERTKLKAELKKIGRETREYRALDARQWAMKIVANSFYGMLGYPRARWYSKQCAESVTSFGRHYIHRTIEMAREFGLEVVYGDTDSLHCKLNGKTREEAMVFLRKVNESLPGIMELELEGFYPRGIFITKKRYAMVDDEGRMVVKGLEFVRRDWAAIAKKTQEEVLRAILRDGSPKKAAEIIRKTTRDVYEGRVNLEDLIIYTQLKMPIESYKAIGPHVVAAKRLRELGHEIEPGMMIAYIEVKGPGSISDRAVPVEDFEGKEYDPDYYVGHQILPAVMRIMEVLGYSEEDLKFEREKQIGLDRFMK

SEQ ID NO: 2381 - protein, 809 aa, synthetic construct
  REGION 1..809: note = Description of Artificial Sequence: Synthetic polypeptide
MRGLLFDVDIAEEEERPNVRLFVKVASETVVAIDPQFEEYFYVVADHPAKTSKLIEKIELDEGGRPIRPKSVEMVRRTLLGNEVEAIRVSFHQPRDAAKLRHKIRELPGVKEIYEFDIPPARRYLIDRGLTPMAGIEFSGSIEVRDGVKTVVMDGPPKPAPVEETRLNIMSFAIAVYNPTGSVRPDKDPIIMISLADNRGLRKVITWKNFDKKPEYVEVVGSEREMIKKFVELVKERDVDILLGYNTDLFDLPYIRSRAKQLRVKLDLGRDGSELVVRKRRFATASKIRGRVHVDVFAMVDFLATIGSIRLIHYSLADVYRHYAGREKPDFEFSEMINAWERGGDAGRRFLEYSMSDADATLEVGSELLPLFLGLTRVVGQTLFDVQRMTPGQLVEWLLVAEAHRIGELVPPRPVGEEFEERAEGTFTGAYVMEPVKGLHEDLVVFDFRSYAPSIIVTHNIDPSTLNCRDCKPGEREQVPGLSYYFCKRRKGFIPAVLERVIEERTKLKAELKKIGRETREYRALDARQWAMKIVANSFYGMLGYPRARWYSKQCAESVTSFGRHYIHRTIEMAREFGLEVVYGDTDSLHCKLNGKTREEAMVFLRKVNESLPGIMELELEGFYPRGIFITKKRYAMVDDEGRMVVKGLEFVRRDWAAIAKKTQEEVLRAILRDGSPKKAAEIIRKTTRDVYEGRVNLEDLIIYTQLKMPIESYKAIGPHVVAAKRLRELGHEIEPGMMIAYIEVKGPGSISDRAVPVEDFEGKEYDPDYYVGHQILPAVMRIMEVLGYSEEDLKFEREKQIGLDRFMK

SEQ ID NO: 2382 - protein, 809 aa, synthetic construct
  REGION 1..809: note = Description of Artificial Sequence: Synthetic polypeptide
MRGLLFDVDIAEEEERPNVRLFVKVASETVVAIDPQFEEYFYVVADHPAKTSKLIEKIELDEGGRPIRPKSVEMVRRTLLGNEVEAIRVSFHQPRDAAKLRHKIRELPGVKEIYEFDIPPARRYLIDRGLTPMAGIEFSGSIEVRDGVKTVVMDGPPKPAPVEETRLNIMSFAIAVYNPTGSVRPDKDPIIMISLADNRGLRKVITWKNFDKKPEYVEVVGSEREMIKKFVELVKERDVDILLGYNTDLFDLPYIRSRAKQLRVKLDLGRDGSELVVRKRRFATASKIRGRVHVDVFAMVDFLATIGSIRLIHYSLADVYRHYAGREKPDFEFSEMINAWERGGDAGRRFLEYSMSDADATLEVGSELLPLFLGLTRVVGQTLFDVQRMTPGQLVEWLLVAEAHRIGELVPPRPVGEEFEERAEGTFTGAYVMEPVKGLHEDLVVFDFRSSAASIIVTHNIDPSTLNCRDCKPGEREQVPGLSYYFCKRRKGFIPAVLERVIEERTKLKAELKKIGRETREYRALDARQWAMKIVANSFYGMLGYPRARWYSKQCAESVTSFGRHYIHRTIEMAREFGLEVVYGDTDSLHCKLNGKTREEAMVFLRKVNESLPGIMELELEGFYPRGIFITKKRYAMVDDEGRMVVKGLEFVRRDWAAIAKKTQEEVLRAILRDGSPKKAAEIIRKTTRDVYEGRVNLEDLIIYTQLKMPIESYKAIGPHVVAAKRLRELGHEIEPGMMIAYIEVKGPGSISDRAVPVEDFEGKEYDPDYYVGHQILPAVMRIMEVLGYSEEDLKFEREKQIGLDRFMK

SEQ ID NO: 2383 - protein, 809 aa, synthetic construct
  REGION 1..809: note = Description of Artificial Sequence: Synthetic polypeptide
MRGLLFDVDIAEEEERPNVRLFVKVASETVVAIDPQFEEYFYVVADHPAKTSKLIEKIELDEGGRPIRPKSVEMVRRTLLGNEVEAIRVSFHQPRDAAKLRHKIRELPGVKEIYEFDIPPARRYLIDRGLTPMAGIEFSGSIEVRDGVKTVVMDGPPKPAPVEETRLNIMSFAIAVYNPTGSVRPDKDPIIMISLADNRGLRKVITWKNFDKKPEYVEVVGSEREMIKKFVELVKERDVDILLGYNTDLFDLPYIRSRAKQLRVKLDLGRDGSELVVRKRRFATASKIRGRVHVDVFAMVDFLATIGSIRLIHYSLADVYRHYAGREKPDFEFSEMINAWERGGDAGRRFLEYSMSDADATLEVGSELLPLFLGLTRVVGQTLFDVQRMTPGQLVEWLLVAEAHRIGELVPPRPVGEEFEERAEGTFTGAYVMEPVKGLHEDLVVFDFRSAAPSIIVTHNIDPSTLNCRDCKPGEREQVPGLSYYFCKRRKGFIPAVLERVIEERTKLKAELKKIGRETREYRALDARQWAMKIVANSFYGMLGYPRARWYSKQCAESVTSFGRHYIHRTIEMAREFGLEVVYGDTDSLHCKLNGKTREEAMVFLRKVNESLPGIMELELEGFYPRGIFITKKRYAMVDDEGRMVVKGLEFVRRDWAAIAKKTQEEVLRAILRDGSPKKAAEIIRKTTRDVYEGRVNLEDLIIYTQLKMPIESYKAIGPHVVAAKRLRELGHEIEPGMMIAYIEVKGPGSISDRAVPVEDFEGKEYDPDYYVGHQILPAVMRIMEVLGYSEEDLKFEREKQIGLDRFMK

SEQ ID NO: 2384 - protein, 809 aa, synthetic construct
  REGION 1..809: note = Description of Artificial Sequence: Synthetic polypeptide
MRGLLFDVDIAEEEERPNVRLFVKVASETVVAIDPQFEEYFYVVADHPAKTSKLIEKIELDEGGRPIRPKSVEMVRRTLLGNEVEAIRVSFHQPRDAAKLRHKIRELPGVKEIYEFDIPPARRYLIDRGLTPMAGIEFSGSIEVRDGVKTVVMDGPPKPAPVEETRLNIMSFAIAVYNPTGSVRPDKDPIIMISLADNRGLRKVITWKNFDKKPEYVEVVGSEREMIKKFVELVKERDVDILLGYNTDLFDLPYIRSRAKQLRVKLDLGRDGSELVVRKRRFATASKIRGRVHVDVFAMVDFLATIGSIRLIHYSLADVYRHYAGREKPDFEFSEMINAWERGGDAGRRFLEYSMSDADATLEVGSELLPLFLGLTRVVGQTLFDVQRMTPGQLVEWLLVAEAHRIGELVPPRPVGEEFEERAEGTFTGAYVMEPVKGLHEDLVVFDFRSYAASIIVTHNIDPSTLNCRDCKPGEREQVPGLSYYFCKRRKGFIPAVLERVIEERTKLKAELKKIGRETREYRALDARQWAMKIVANSFYGMLGYPRARWYSKQCAESVTSFGRHYIHRTIEMAREFGLEVVYGDTDSLHCKLNGKTREEAMVFLRKVNESLPGIMELELEGFYPRGIFITKKRYAMVDDEGRMVVKGLEFVRRDWAAIAKKTQEEVLRAILRDGSPKKAAEIIRKTTRDVYEGRVNLEDLIIYTQLKMPIESYKAIGPHVVAAKRLRELGHEIEPGMMIAYIEVKGPGSISDRAVPVEDFEGKEYDPDYYVGHQILPAVMRIMEVLGYSEEDLKFEREKQIGLDRFMK

SEQ ID NO: 2385 - protein, 809 aa, synthetic construct
  REGION 1..809: note = Description of Artificial Sequence: Synthetic polypeptide
MRGLLFDVDIAEEEERPNVRLFVKVASETVVAIDPQFEEYFYVVADHPAKTSKLIEKIELDEGGRPIRPKSVEMVRRTLLGNEVEAIRVSFHQPRDAAKLRHKIRELPGVKEIYEFDIPPARRYLIDRGLTPMAGIEFSGSIEVRDGVKTVVMDGPPKPAPVEETRLNIMSFAIAVYNPTGSVRPDKDPIIMISLADNRGLRKVITWKNFDKKPEYVEVVGSEREMIKKFVELVKERDVDILLGYNTDLFDLPYIRSRAKQLRVKLDLGRDGSELVVRKRRFATASKIRGRVHVDVFAMVDFLATIGSIRLIHYSLADVYRHYAGREKPDFEFSEMINAWERGGDAGRRFLEYSMSDADATLEVGSELLPLFLGLTRVVGQTLFDVQRMTPGQLVEWLLVAEAHRIGELVPPRPVGEEFEERAEGTFTGAYVMEPVKGLHEDLVVFDFRSYGPSIIVTHNIDPSTLNCRDCKPGEREQVPGLSYYFCKRRKGFIPAVLERVIEERTKLKAELKKIGRETREYRALDARQWAMKIVANSFYGMLGYPRARWYSKQCAESVTSFGRHYIHRTIEMAREFGLEVVYGDTDSLHCKLNGKTREEAMVFLRKVNESLPGIMELELEGFYPRGIFITKKRYAMVDDEGRMVVKGLEFVRRDWAAIAKKTQEEVLRAILRDGSPKKAAEIIRKTTRDVYEGRVNLEDLIIYTQLKMPIESYKAIGPHVVAAKRLRELGHEIEPGMMIAYIEVKGPGSISDRAVPVEDFEGKEYDPDYYVGHQILPAVMRIMEVLGYSEEDLKFEREKQIGLDRFMK

SEQ ID NO: 2386 - protein, 809 aa, synthetic construct
  REGION 1..809: note = Description of Artificial Sequence: Synthetic polypeptide
MRGLLFDVDIAEEEERPNVRLFVKVASETVVAIDPQFEEYFYVVADHPAKTSKLIEKIELDEGGRPIRPKSVEMVRRTLLGNEVEAIRVSFHQPRDAAKLRHKIRELPGVKEIYEFDIPPARRYLIDRGLTPMAGIEFSGSIEVRDGVKTVVMDGPPKPAPVEETRLNIMSFAIAVYNPTGSVRPDKDPIIMISLADNRGLRKVITWKNFDKKPEYVEVVGSEREMIKKFVELVKERDVDILLGYNTDLFDLPYIRSRAKQLRVKLDLGRDGSELVVRKRRFATASKIRGRVHVDVFAMVDFLATIGSIRLIHYSLADVYRHYAGREKPDFEFSEMINAWERGGDAGRRFLEYSMSDADATLEVGSELLPLFLGLTRVVGQTLFDVQRMTPGQLVEWLLVAEAHRIGELVPPRPVGEEFEERAEGTFTGAYVMEPVKGLHEDLVVFDFRSFAPSIIVTHNIDPSTLNCRDCKPGEREQVPGLSYYFCKRRKGFIPAVLERVIEERTKLKAELKKIGRETREYRALDARQWAMKIVANSFYGMLGYPRARWYSKQCAESVTSFGRHYIHRTIEMAREFGLEVVYGDTDSLHCKLNGKTREEAMVFLRKVNESLPGIMELELEGFYPRGIFITKKRYAMVDDEGRMVVKGLEFVRRDWAAIAKKTQEEVLRAILRDGSPKKAAEIIRKTTRDVYEGRVNLEDLIIYTQLKMPIESYKAIGPHVVAAKRLRELGHEIEPGMMIAYIEVKGPGSISDRAVPVEDFEGKEYDPDYYVGHQILPAVMRIMEVLGYSEEDLKFEREKQIGLDRFMK

SEQ ID NO: 2387 - protein, 809 aa, synthetic construct
  REGION 1..809: note = Description of Artificial Sequence: Synthetic polypeptide
MRGLLFDVDIAEEEERPNVRLFVKVASETVVAIDPQFEEYFYVVADHPAKTSKLIEKIELDEGGRPIRPKSVEMVRRTLLGNEVEAIRVSFHQPRDAAKLRHKIRELPGVKEIYEFDIPPARRYLIDRGLTPMAGIEFSGSIEVRDGVKTVVMDGPPKPAPVEETRLNIMSFAIAVYNPTGSVRPDKDPIIMISLADNRGLRKVITWKNFDKKPEYVEVVGSEREMIKKFVELVKERDVDILLGYNTDLFDLPYIRSRAKQLRVKLDLGRDGSELVVRKRRFATASKIRGRVHVDVFAMVDFLATIGSIRLIHYSLADVYRHYAGREKPDFEFSEMINAWERGGDAGRRFLEYSMSDADATLEVGSELLPLFLGLTRVVGQTLFDVQRMTPGQLVEWLLVAEAHRIGELVPPRPVGEEFEERAEGTFTGAYVMEPVKGLHEDLVVFDFRSFAASIIVTHNIDPSTLNCRDCKPGEREQVPGLSYYFCKRRKGFIPAVLERVIEERTKLKAELKKIGRETREYRALDARQWAMKIVANSFYGMLGYPRARWYSKQCAESVTSFGRHYIHRTIEMAREFGLEVVYGDTDSLHCKLNGKTREEAMVFLRKVNESLPGIMELELEGFYPRGIFITKKRYAMVDDEGRMVVKGLEFVRRDWAAIAKKTQEEVLRAILRDGSPKKAAEIIRKTTRDVYEGRVNLEDLIIYTQLKMPIESYKAIGPHVVAAKRLRELGHEIEPGMMIAYIEVKGPGSISDRAVPVEDFEGKEYDPDYYVGHQILPAVMRIMEVLGYSEEDLKFEREKQIGLDRFMK

SEQ ID NO: 2388 - protein, 809 aa, synthetic construct
  REGION 1..809: note = Description of Artificial Sequence: Synthetic polypeptide
MRGLLFDVDIAEEEERPNVRLFVKVASETVVAIDPQFEEYFYVVADHPAKTSKLIEKIELDEGGRPIRPKSVEMVRRTLLGNEVEAIRVSFHQPRDAAKLRHKIRELPGVKEIYEFDIPPARRYLIDRGLTPMAGIEFSGSIEVRDGVKTVVMDGPPKPAPVEETRLNIMSFAIAVYNPTGSVRPDKDPIIMISLADNRGLRKVITWKNFDKKPEYVEVVGSEREMIKKFVELVKERDVDILLGYNTDLFDLPYIRSRAKQLRVKLDLGRDGSELVVRKRRFATASKIRGRVHVDVFAMVDFLATIGSIRLIHYSLADVYRHYAGREKPDFEFSEMINAWERGGDAGRRFLEYSMSDADATLEVGSELLPLFLGLTRVVGQTLFDVQRMTPGQLVEWLLVAEAHRIGELVPPRPVGEEFEERAEGTFTGAYVMEPVKGLHEDLVVFDFRSYAPSIIVTHNIDPSTLNCRDCKPGEREQVPGLSYYFCKRRKGFIPAVLERVIEERTKLKAELKKIGRETREYRALDARQWAMKIVANSFYGMLGYPRARWYSKQCAESVSSFGRHYIHRTIEMAREFGLEVVYGDTDSLHCKLNGKTREEAMVFLRKVNESLPGIMELELEGFYPRGIFITKKRYAMVDDEGRMVVKGLEFVRRDWAAIAKKTQEEVLRAILRDGSPKKAAEIIRKTTRDVYEGRVNLEDLIIYTQLKMPIESYKAIGPHVVAAKRLRELGHEIEPGMMIAYIEVKGPGSISDRAVPVEDFEGKEYDPDYYVGHQILPAVMRIMEVLGYSEEDLKFEREKQIGLDRFMK

SEQ ID NO: 2389 - protein, 809 aa, synthetic construct
  REGION 1..809: note = Description of Artificial Sequence: Synthetic polypeptide
MRGLLFDVDIAEEEERPNVRLFVKVASETVVAIDPQFEEYFYVVADHPAKTSKLIEKIELDEGGRPIRPKSVEMVRRTLLGNEVEAIRVSFHQPRDAAKLRHKIRELPGVKEIYEFDIPPARRYLIDRGLTPMAGIEFSGSIEVRDGVKTVVMDGPPKPAPVEETRLNIMSFAIAVYNPTGSVRPDKDPIIMISLADNRGLRKVITWKNFDKKPEYVEVVGSEREMIKKFVELVKERDVDILLGYNTDLFDLPYIRSRAKQLRVKLDLGRDGSELVVRKRRFATASKIRGRVHVDVFAMVDFLATIGSIRLIHYSLADVYRHYAGREKPDFEFSEMINAWERGGDAGRRFLEYSMSDADATLEVGSELLPLFLGLTRVVGQTLFDVQRMTPGQLVEWLLVAEAHRIGELVPPRPVGEEFEERAEGTFTGAYVMEPVKGLHEDLVVFDFRSLAPSIIVTHNIDPSTLNARDCKPGEREQVPGLSYYFCKRRKGFIPAVLERVIEERTKLKAELKKIGRETREYRALDARQWAMKIVANSFYGMLGYPRARWYSKQCAESVTSFGRHYIHRTIEMAREFGLEVVYGDTDSLHCKLNGKTREEAMVFLRKVNESLPGIMELELEGFYPRGIFITKKRYAMVDDEGRMVVKGLEFVRRDWAAIAKKTQEEVLRAILRDGSPKKAAEIIRKTTRDVYEGRVNLEDLIIYTQLKMPIESYKAIGPHVVAAKRLRELGHEIEPGMMIAYIEVKGPGSISDRAVPVEDFEGKEYDPDYYVGHQILPAVMRIMEVLGYSEEDLKFEREKQIGLDRFMK

SEQ ID NO: 2390 - protein, 809 aa, synthetic construct
  REGION 1..809: note = Description of Artificial Sequence: Synthetic polypeptide
MRGLLFDVDIAEEEERPNVRLFVKVASETVVAIDPQFEEYFYVVADHPAKTSKLIEKIELDEGGRPIRPKSVEMVRRTLLGNEVEAIRVSFHQPRDAAKLRHKIRELPGVKEIYEFDIPPARRYLIDRGLTPMAGIEFSGSIEVRDGVKTVVMDGPPKPAPVEETRLNIMSFAIAVYNPTGSVRPDKDPIIMISLADNRGLRKVITWKNFDKKPEYVEVVGSEREMIKKFVELVKERDVDILLGYNTDLFDLPYIRSRAKQLRVKLDLGRDGSELVVRKRRFATASKIRGRVHVDVFAMVDFLATIGSIRLIHYSLADVYRHYAGREKPDFEFSEMINAWERGGDAGRRFLEYSMSDADATLEVGSELLPLFLGLTRVVGQTLFDVQRMTPGQLVEWLLVAEAHRIGELVPPRPVGEEFEERAEGTFTGAYVMEPVKGLHEDLVVFDFRSYAPSIIVTHNIDPSTLNCRDCKPGEREQVPGLSYYFCKRRKGFIPAVLERVIEERTKLKAELKKIGRETREYRALDARQWAMKIVANSFYGMLGYPRARWYSKQCAESVASFGRHYIHRTIEMAREFGLEVVYGDTDSLHCKLNGKTREEAMVFLRKVNESLPGIMELELEGFYPRGIFITKKRYAMVDDEGRMVVKGLEFVRRDWAAIAKKTQEEVLRAILRDGSPKKAAEIIRKTTRDVYEGRVNLEDLIIYTQLKMPIESYKAIGPHVVAAKRLRELGHEIEPGMMIAYIEVKGPGSISDRAVPVEDFEGKEYDPDYYVGHQILPAVMRIMEVLGYSEEDLKFEREKQIGLDRFMK

SEQ ID NO: 2391 - protein, 809 aa, synthetic construct
  REGION 1..809: note = Description of Artificial Sequence: Synthetic polypeptide
MRGLLFDVDIAEEEERPNVRLFVKVASETVVAIDPQFEEYFYVVADHPAKTSKLIEKIELDEGGRPIRPKSVEMVRRTLLGNEVEAIRVSFHQPRDAAKLRHKIRELPGVKEIYEFDIPPARRYLIDRGLTPMAGIEFSGSIEVRDGVKTVVMDGPPKPAPVEETRLNIMSFAIAVYNPTGSVRPDKDPIIMISLADNRGLRKVITWKNFDKKPEYVEVVGSEREMIKKFVELVKERDVDILLGYNTDLFDLPYIRSRAKQLRVKLDLGRDGSELVVRKRRFATASKIRGRVHVDVFAMVDFLATIGSIRLIHYSLADVYRHYAGREKPDFEFSEMINAWERGGDAGRRFLEYSMSDADATLEVGSELLPLFLGLTRVVGQTLFDVQRMTPGQLVEWLLVAEAHRIGELVPPRPVGEEFEERAEGTFTGAYVMEPVKGLHEDLVVFDFRSYAPSIIVTHNIDPSTLNCRDCKPGEREQVPGLSYYFCKRRKGFIPAVLERVIEERTKLKAELKKIGRETREYRALDARQWAMKIVANSFYGMLGYPRARWYSKQCAESVSAFGRHYIHRTIEMAREFGLEVVYGDTDSLHCKLNGKTREEAMVFLRKVNESLPGIMELELEGFYPRGIFITKKRYAMVDDEGRMVVKGLEFVRRDWAAIAKKTQEEVLRAILRDGSPKKAAEIIRKTTRDVYEGRVNLEDLIIYTQLKMPIESYKAIGPHVVAAKRLRELGHEIEPGMMIAYIEVKGPGSISDRAVPVEDFEGKEYDPDYYVGHQILPAVMRIMEVLGYSEEDLKFEREKQIGLDRFMK

SEQ ID NO: 2392 - protein, 809 aa, synthetic construct
  REGION 1..809: note = Description of Artificial Sequence: Synthetic polypeptide
MRGLLFDVDFAEEEERPNVRLFVKVASETVVAIDPQFEEYFYVVADHPAKTSKLIEKIELDEGGRPIRPKSVEMVRRTLLGNEVEAIRVSFHQPRDAAKLRHKIRELPGVKEIYEFDIPPARRYLIDRGLTPMAGIEFSGSIEVRDGVKTVVMDGPPKPAPVEETRLNIMSFAIAVYNPTGSVRPDKDPIIMISLADNRGLRKVITWKNFDKKPEYVEVVGSEREMIKKFVELVKERDVDILLGYNTDLFDLPYIRSRAKQLRVKLDLGRDGSELVVRKRRFATASKIRGRVHVDVFAMVDFLATIGSIRLIHYSLADVYRHYAGREKPDFEFSEMINAWERGGDAGRRFLEYSMSDADATLEVGSELLPLFLGLTRVVGQTLFDVQRMTPGQLVEWLLVAEAHRIGELVPPRPVGEEFEERAEGTFTGAYVMEPVKGLHEDLVVFDFRSSAASIIVTHNIDPSTLNCRDCKPGEREQVPGLSYYFCKRRKGFIPAVLERVIEERTKLKAELKKIGRETREYRALDARQWAMKIVANSFYGMLGYPRARWYSKQCAESVTSFGRHYIHRTIEMAREFGLEVVYGDTDSLHCKLNGKTREEAMVFLRKVNESLPGIMELELEGFYPRGIFITKKRYAMVDDEGRMVVKGLEFVRRDWAAIAKKTQEEVLRAILRDGSPKKAAEIIRKTTRDVYEGRVNLEDLIIYTQLKMPIESYKAIGPHVVAAKRLRELGHEIEPGMMIAYIEVKGPGSISDRAVPVEDFEGKEYDPDYYVGHQILPAVMRIMEVLGYSEEDLKFEREKQIGLDRFMK

SEQ ID NO: 2393 - protein, 774 aa, Thermococcus sp.
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGIRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCENYDIAPIVGYKFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGGGRISDRVILLTEYDPEKHKYDPDYYIENQVLPAVLRILEAFGYRKEDLRYQSSKQTGLDAWLKR

SEQ ID NO: 2394 - protein, 774 aa, synthetic construct
  REGION 1..774: note = Description of Artificial Sequence: Synthetic polypeptide
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFAIATFYHEGDEFGKGEIIMISYADEEEARVITWKNIDLPYVDVVSNEREMIKRFVQVVKEKDPDVIITYNGDNFDLPYLIKRAEKLGIRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLAPSIIVTHNVSPDTLEKEGCENYDIAPIVGYKFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGGGRISDRVILLTEYDPEKHKYDPDYYIENQVLPAVLRILEAFGYRKEDLRYQSSKQTGLDAWLKR

SEQ ID NO: 2395 - protein, 774 aa, synthetic construct
  REGION 1..774: note = Description of Artificial Sequence: Synthetic polypeptide
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFAIATFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSAAASIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 2396 - protein, 774 aa, synthetic construct
  REGION 1..774: note = Description of Artificial Sequence: Synthetic polypeptide
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFAIATFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSSAPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYHEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 2397 - protein, 774 aa, synthetic construct
  REGION 1..774: note = Description of Artificial Sequence: Synthetic polypeptide
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFAIATFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSAAASIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYHEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 2398 - protein, 774 aa, synthetic construct
  REGION 1..774: note = Description of Artificial Sequence: Synthetic polypeptide
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFAIATFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSSGPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYHEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 2399 - protein, 774 aa, synthetic construct
  REGION 1..774: note = Description of Artificial Sequence: Synthetic polypeptide
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFAIATFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSSAGSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 2400 - protein, 774 aa, synthetic construct
  REGION 1..774: note = Description of Artificial Sequence: Synthetic polypeptide
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFAIATFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSSAPSIIVTHNVSPDTLEKEGCENYDIAPIVSYRFCKDFPGFIPSILGDLIAMRQEIKKKMKATIDPIEKKMLDYRQRSVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 2401 - protein, 774 aa, synthetic construct
  REGION 1..774: note = Description of Artificial Sequence: Synthetic polypeptide
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFAIATFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSSGPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 2402 - protein, 774 aa, synthetic construct
  REGION 1..774: note = Description of Artificial Sequence: Synthetic polypeptide
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFAIATFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSAAASIIVTHNVSPDTLEKEGCENYDIAPIVSYRFCKDFPGFIPSILGDLIAMRQEIKKKMKATIDPIEKKMLDYRQRSVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 2403 - protein, 774 aa, synthetic construct
  REGION 1..774: note = Description of Artificial Sequence: Synthetic polypeptide
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFAIATFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSSAGSIIVTHNVSPDTLEKEGCENYDIAPIVSYRFCKDFPGFIPSILGDLIAMRQEIKKKMKATIDPIEKKMLDYRQRSVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 2404 - protein, 774 aa, synthetic construct
  REGION 1..774: note = Description of Artificial Sequence: Synthetic polypeptide
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFAIATFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSSAPSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 2405 - protein, 774 aa, synthetic construct
  REGION 1..774: note = Description of Artificial Sequence: Synthetic polypeptide
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFAIATFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSSGPSIIVTHNVSPDTLEKEGCENYDIAPIVSYRFCKDFPGFIPSILGDLIAMRQEIKKKMKATIDPIEKKMLDYRQRSVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 2406 - protein, 774 aa, synthetic construct
  REGION 1..774: note = Description of Artificial Sequence: Synthetic polypeptide
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFAIATFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSSAGSIIVTHNVSPDTLEKEGCENYDIAPIVSYRFCKDFPGFIPSILGDLIAMRQEIKKKMKATIDPIEKKMLDYRQRAVKLLANSYYGYMGYPKARWYSKECAESVTAWGRHYHEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 2407 - protein, 774 aa, synthetic construct
  REGION 1..774: note = Description of Artificial Sequence: Synthetic polypeptide
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFAIATFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSSAPSIIVTHNVSPDTLEKEGCENYDIAPIVSYRFCKDFPGFIPSILGDLIAMRQEIKKKMKATIDPIEKKMLDYRQRSVKLLANSYYGYMGYPKARWYSLECAESVTAWGRHYHEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGSGKISDRVILLTEYDPEKHKYDPDYYIENQVLPAVLRILEAFGYRKEDLRYQSSKQTGLDTWLKR

SEQ ID NO: 2408 - protein, 806 aa, unidentified
  REGION 1..806: note = Description of Unknown: Candidatus Hadarchaeum yellowstonense sequence
MLLDVDYAEEEEKPSIRLFVKTGSEVLVAIDPDFEEYFYVVSDHPAKASKLIEKVEVEEDGVSIRPKGVEIVKRTFLGNEVEAIKVSFYQAKDSSKLRHKIRELPGVREIYEFDIPPARRYLIDRGLTPMAGVEFDGRIEERQGIKTVILDSPPRPAQVEEPKLNIMSFDIEVYNPTGSVRPDKDPIIMISLADNNGLRKVITWKNFERSQEYVEVVGSEREMIKRFVDLVKERDVDILLGYNTDLFDLPYIRSRAKQLKVKLDLGRDGSELVVRKRRFATASKIRGRIHVDVFAMVDFLATIGSIKLIHYSLADVYRHLLGKEKPDFEFTEMVDAWEKGGDAGRKFLEYSMSDADATLEVGLELLPLFLGLTRVVGQTLFDVQRMTPGQLVEWLLVAEAHRIGELVPGRPVGEEYEERMEETFVGAYVMEPVKGLHENLVVFDFRSLYPSIIVTHNIDPSTLNCKDCKPGEREQVPGLEYYFCRRRKGFIPATLQRIIEERMKLKAELKKLVRGTKEYRALDARQWAMKIVANSFYGMLGYPRARWYSKECAESVTSFGRHYIHKTIDMAREFGLEVVYGDTDSLHCKLNGKTREEALAFLKKVNDSLPGIMELELEGFYPRGIFITKKRYAMIDDEGRMVVKGLEFVRRDWAAIAKKTQEEVLKAILRDGSPEKAAEIIRKTTRDVYEGRVNLEDLIIYTQLKMPIESYKAIGPHVVAAKRLRELGHEIEPGMMIAYVEVKGPGSISERAVPVEDFKGREYDPDYYVGHQVLPAVMRIMEVLGYREIDLKFERQRQVGLDRFMK

SEQ ID NO: 2409 - protein, 806 aa, synthetic construct
  REGION 1..806: note = Description of Artificial Sequence: Synthetic polypeptide
MLLDVDYAEEEEKPSIRLFVKTGSEVLVAIDPDFEEYFYVVSDHPAKASKLIEKVEVEEDGVSIRPKGVEIVKRTFLGNEVEAIKVSFYQAKDSSKLRHKIRELPGVREIYEFDIPPARRYLIDRGLTPMAGVEFDGRIEERQGIKTVILDSPPRPAQVEEPKLNIMSFAIAVYNPTGSVRPDKDPIIMISLADNNGLRKVITWKNFERSQEYVEVVGSEREMIKRFVDLVKERDVDILLGYNTDLFDLPYIRSRAKQLKVKLDLGRDGSELVVRKRRFATASKIRGRIHVDVFAMVDFLATIGSIKLIHYSLADVYRHLLGKEKPDFEFTEMVDAWEKGGDAGRKFLEYSMSDADATLEVGLELLPLFLGLTRVVGQTLFDVQRMTPGQLVEWLLVAEAHRIGELVPGRPVGEEYEERMEETFVGAYVMEPVKGLHENLVVFDFRSAAGSIIVTHNIDPSTLNCKDCKPGEREQVPGLEYYFCRRRKGFIPATLQRIIEERMKLKAELKKLVRGTKEYRALDARQWAMKIVANSFYGMLGYPRARWYSKECAESVTSFGRHYIHKTIDMAREFGLEVVYGDTDSLHCKLNGKTREEALAFLKKVNDSLPGIMELELEGFYPRGIFITKKRYAMIDDEGRMVVKGLEFVRRDWAAIAKKTQEEVLKAILRDGSPEKAAEIIRKTTRDVYEGRVNLEDLIIYTQLKMPIESYKAIGPHVVAAKRLRELGHEIEPGMMIAYVEVKGPGSISERAVPVEDFKGREYDPDYYVGHQVLPAVMRIMEVLGYREIDLKFERQRQVGLDRFMK

SEQ ID NO: 2410 - protein, 806 aa, synthetic construct
  REGION 1..806: note = Description of Artificial Sequence: Synthetic polypeptide
MLLDVDYAEEEEKPSIRLFVKTGSEVLVAIDPDFEEYFYVVSDHPAKASKLIEKVEVEEDGVSIRPKGVEIVKRTFLGNEVEAIKVSFYQAKDSSKLRHKIRELPGVREIYEFDIPPARRYLIDRGLTPMAGVEFDGRIEERQGIKTVILDSPPRPAQVEEPKLNIMSFAIAVYNPTGSVRPDKDPIIMISLADNNGLRKVITWKNFERSQEYVEVVGSEREMIKRFVDLVKERDVDILLGYNTDLFDLPYIRSRAKQLKVKLDLGRDGSELVVRKRRFATASKIRGRIHVDVFAMVDFLATIGSIKLIHYSLADVYRHLLGKEKPDFEFTEMVDAWEKGGDAGRKFLEYSMSDADATLEVGLELLPLFLGLTRVVGQTLFDVQRMTPGQLVEWLLVAEAHRIGELVPGRPVGEEYEERMEETFVGAYVMEPVKGLHENLVVFDFRSFAPSIIVTHNIDPSTLNCKDCKPGEREQVPGLEYYFCRRRKGFIPATLQRIIEERMKLKAELKKLVRGTKEYRALDARQWAMKIVANSFYGMLGYPRARWYSKECAESVTSFGRHYIHKTIDMAREFGLEVVYGDTDSLHCKLNGKTREEALAFLKKVNDSLPGIMELELEGFYPRGIFITKKRYAMIDDEGRMVVKGLEFVRRDWAAIAKKTQEEVLKAILRDGSPEKAAEIIRKTTRDVYEGRVNLEDLIIYTQLKMPIESYKAIGPHVVAAKRLRELGHEIEPGMMIAYVEVKGPGSISERAVPVEDFKGREYDPDYYVGHQVLPAVMRIMEVLGYREIDLKFERQRQVGLDRFMK

SEQ ID NO: 2411 - protein, 806 aa, synthetic construct
  REGION 1..806: note = Description of Artificial Sequence: Synthetic polypeptide
MLLDVDYAEEEEKPSIRLFVKTGSEVLVAIDPDFEEYFYVVSDHPAKASKLIEKVEVEEDGVSIRPKGVEIVKRTFLGNEVEAIKVSFYQAKDSSKLRHKIRELPGVREIYEFDIPPARRYLIDRGLTPMAGVEFDGRIEERQGIKTVILDSPPRPAQVEEPKLNIMSFAIAVYNPTGSVRPDKDPIIMISLADNNGLRKVITWKNFERSQEYVEVVGSEREMIKRFVDLVKERDVDILLGYNTDLFDLPYIRSRAKQLKVKLDLGRDGSELVVRKRRFATASKIRGRIHVDVFAMVDFLATIGSIKLIHYSLADVYRHLLGKEKPDFEFTEMVDAWEKGGDAGRKFLEYSMSDADATLEVGLELLPLFLGLTRVVGQTLFDVQRMTPGQLVEWLLVAEAHRIGELVPGRPVGEEYEERMEETFVGAYVMEPVKGLHENLVVFDFRSYAPSIIVTHNIDPSTLNCKDCKPGEREQVPGLEYYFCRRRKGFIPATLQRIIEERMKLKAELKKLVRGTKEYRALDARQWAMKIVANSFYGMLGYPRARWYSKECAESVTSFGRHYIHKTIDMAREFGLEVVYGDTDSLHCKLNGKTREEALAFLKKVNDSLPGIMELELEGFYPRGIFITKKRYAMIDDEGRMVVKGLEFVRRDWAAIAKKTQEEVLKAILRDGSPEKAAEIIRKTTRDVYEGRVNLEDLIIYTQLKMPIESYKAIGPHVVAAKRLRELGHEIEPGMMIAYVEVKGPGSISERAVPVEDFKGREYDPDYYVGHQVLPAVMRIMEVLGYREIDLKFERQRQVGLDRFMK

SEQ ID NO: 2412 - protein, 806 aa, synthetic construct
  REGION 1..806: note = Description of Artificial Sequence: Synthetic polypeptide
MLLDVDYAEEEEKPSIRLFVKTGSEVLVAIDPDFEEYFYVVSDHPAKASKLIEKVEVEEDGVSIRPKGVEIVKRTFLGNEVEAIKVSFYQAKDSSKLRHKIRELPGVREIYEFDIPPARRYLIDRGLTPMAGVEFDGRIEERQGIKTVILDSPPRPAQVEEPKLNIMSFAIAVYNPTGSVRPDKDPIIMISLADNNGLRKVITWKNFERSQEYVEVVGSEREMIKRFVDLVKERDVDILLGYNTDLFDLPYIRSRAKQLKVKLDLGRDGSELVVRKRRFATASKIRGRIHVDVFAMVDFLATIGSIKLIHYSLADVYRHLLGKEKPDFEFTEMVDAWEKGGDAGRKFLEYSMSDADATLEVGLELLPLFLGLTRVVGQTLFDVQRMTPGQLVEWLLVAEAHRIGELVPGRPVGEEYEERMEETFVGAYVMEPVKGLHENLVVFDFRSYAGSIIVTHNIDPSTLNCKDCKPGEREQVPGLEYYFCRRRKGFIPATLQRIIEERMKLKAELKKLVRGTKEYRALDARQWAMKIVANSFYGMLGYPRARWYSKECAESVTSFGRHYIHKTIDMAREFGLEVVYGDTDSLHCKLNGKTREEALAFLKKVNDSLPGIMELELEGFYPRGIFITKKRYAMIDDEGRMVVKGLEFVRRDWAAIAKKTQEEVLKAILRDGSPEKAAEIIRKTTRDVYEGRVNLEDLIIYTQLKMPIESYKAIGPHVVAAKRLRELGHEIEPGMMIAYVEVKGPGSISERAVPVEDFKGREYDPDYYVGHQVLPAVMRIMEVLGYREIDLKFERQRQVGLDRFMK

SEQ ID NO: 2413 - protein, 806 aa, synthetic construct
  REGION 1..806: note = Description of Artificial Sequence: Synthetic polypeptide
MLLDVDYAEEEEKPSIRLFVKTGSEVLVAIDPDFEEYFYVVSDHPAKASKLIEKVEVEEDGVSIRPKGVEIVKRTFLGNEVEAIKVSFYQAKDSSKLRHKIRELPGVREIYEFDIPPARRYLIDRGLTPMAGVEFDGRIEERQGIKTVILDSPPRPAQVEEPKLNIMSFAIAVYNPTGSVRPDKDPIIMISLADNNGLRKVITWKNFERSQEYVEVVGSEREMIKRFVDLVKERDVDILLGYNTDLFDLPYIRSRAKQLKVKLDLGRDGSELVVRKRRFATASKIRGRIHVDVFAMVDFLATIGSIKLIHYSLADVYRHLLGKEKPDFEFTEMVDAWEKGGDAGRKFLEYSMSDADATLEVGLELLPLFLGLTRVVGQTLFDVQRMTPGQLVEWLLVAEAHRIGELVPGRPVGEEYEERMEETFVGAYVMEPVKGLHENLVVFDFRSSGASIIVTHNIDPSTLNCKDCKPGEREQVPGLEYYFCRRRKGFIPATLQRIIEERMKLKAELKKLVRGTKEYRALDARQWAMKIVANSFYGMLGYPRARWYSKECAESVTSFGRHYIHKTIDMAREFGLEVVYGDTDSLHCKLNGKTREEALAFLKKVNDSLPGIMELELEGFYPRGIFITKKRYAMIDDEGRMVVKGLEFVRRDWAAIAKKTQEEVLKAILRDGSPEKAAEIIRKTTRDVYEGRVNLEDLIIYTQLKMPIESYKAIGPHVVAAKRLRELGHEIEPGMMIAYVEVKGPGSISERAVPVEDFKGREYDPDYYVGHQVLPAVMRIMEVLGYREIDLKFERQRQVGLDRFMK

SEQ ID NO: 2414 - protein, 806 aa, synthetic construct
  REGION 1..806: note = Description of Artificial Sequence: Synthetic polypeptide
MLLDVDYAEEEEKPSIRLFVKTGSEVLVAIDPDFEEYFYVVSDHPAKASKLIEKVEVEEDGVSIRPKGVEIVKRTFLGNEVEAIKVSFYQAKDSSKLRHKIRELPGVREIYEFDIPPARRYLIDRGLTPMAGVEFDGRIEERQGIKTVILDSPPRPAQVEEPKLNIMSFAIAVYNPTGSVRPDKDPIIMISLADNNGLRKVITWKNFERSQEYVEVVGSEREMIKRFVDLVKERDVDILLGYNTDLFDLPYIRSRAKQLKVKLDLGRDGSELVVRKRRFATASKIRGRIHVDVFAMVDFLATIGSIKLIHYSLADVYRHLLGKEKPDFEFTEMVDAWEKGGDAGRKFLEYSMSDADATLEVGLELLPLFLGLTRVVGQTLFDVQRMTPGQLVEWLLVAEAHRIGELVPGRPVGEEYEERMEETFVGAYVMEPVKGLHENLVVFDFRSAGASIIVTHNIDPSTLNCKDCKPGEREQVPGLEYYFCRRRKGFIPATLQRIIEERMKLKAELKKLVRGTKEYRALDARQWAMKIVANSFYGMLGYPRARWYSKECAESVTSFGRHYIHKTIDMAREFGLEVVYGDTDSLHCKLNGKTREEALAFLKKVNDSLPGIMELELEGFYPRGIFITKKRYAMIDDEGRMVVKGLEFVRRDWAAIAKKTQEEVLKAILRDGSPEKAAEIIRKTTRDVYEGRVNLEDLIIYTQLKMPIESYKAIGPHVVAAKRLRELGHEIEPGMMIAYVEVKGPGSISERAVPVEDFKGREYDPDYYVGHQVLPAVMRIMEVLGYREIDLKFERQRQVGLDRFMK

SEQ ID NO: 2415 - protein, 806 aa, synthetic construct
  REGION 1..806: note = Description of Artificial Sequence: Synthetic polypeptide
MLLDVDYAEEEEKPSIRLFVKTGSEVLVAIDPDFEEYFYVVSDHPAKASKLIEKVEVEEDGVSIRPKGVEIVKRTFLGNEVEAIKVSFYQAKDSSKLRHKIRELPGVREIYEFDIPPARRYLIDRGLTPMAGVEFDGRIEERQGIKTVILDSPPRPAQVEEPKLNIMSFAIAVYNPTGSVRPDKDPIIMISLADNNGLRKVITWKNFERSQEYVEVVGSEREMIKRFVDLVKERDVDILLGYNTDLFDLPYIRSRAKQLKVKLDLGRDGSELVVRKRRFATASKIRGRIHVDVFAMVDFLATIGSIKLIHYSLADVYRHLLGKEKPDFEFTEMVDAWEKGGDAGRKFLEYSMSDADATLEVGLELLPLFLGLTRVVGQTLFDVQRMTPGQLVEWLLVAEAHRIGELVPGRPVGEEYEERMEETFVGAYVMEPVKGLHENLVVFDFRSSGPSIIVTHNIDPSTLNCKDCKPGEREQVPGLEYYFCRRRKGFIPATLQRIIEERMKLKAELKKLVRGTKEYRALDARQWAMKIVANSFYGMLGYPRARWYSKECAESVTSFGRHYIHKTIDMAREFGLEVVYGDTDSLHCKLNGKTREEALAFLKKVNDSLPGIMELELEGFYPRGIFITKKRYAMIDDEGRMVVKGLEFVRRDWAAIAKKTQEEVLKAILRDGSPEKAAEIIRKTTRDVYEGRVNLEDLIIYTQLKMPIESYKAIGPHVVAAKRLRELGHEIEPGMMIAYVEVKGPGSISERAVPVEDFKGREYDPDYYVGHQVLPAVMRIMEVLGYREIDLKFERQRQVGLDRFMK

SEQ ID NO: 2416 - protein, 806 aa, synthetic construct
  REGION 1..806: note = Description of Artificial Sequence: Synthetic polypeptide
MLLDVDYAEEEEKPSIRLFVKTGSEVLVAIDPDFEEYFYVVSDHPAKASKLIEKVEVEEDGVSIRPKGVEIVKRTFLGNEVEAIKVSFYQAKDSSKLRHKIRELPGVREIYEFDIPPARRYLIDRGLTPMAGVEFDGRIEERQGIKTVILDSPPRPAQVEEPKLNIMSFAIAVYNPTGSVRPDKDPIIMISLADNNGLRKVITWKNFERSQEYVEVVGSEREMIKRFVDLVKERDVDILLGYNTDLFDLPYIRSRAKQLKVKLDLGRDGSELVVRKRRFATASKIRGRIHVDVFAMVDFLATIGSIKLIHYSLADVYRHLLGKEKPDFEFTEMVDAWEKGGDAGRKFLEYSMSDADATLEVGLELLPLFLGLTRVVGQTLFDVQRMTPGQLVEWLLVAEAHRIGELVPGRPVGEEYEERMEETFVGAYVMEPVKGLHENLVVFDFRSAAASIIVTHNIDPSTLNCKDCKPGEREQVPGLEYYFCRRRKGFIPATLQRIIEERMKLKAELKKLVRGTKEYRALDARQWAMKIVANSFYGMLGYPRARWYSKECAESVTSFGRHYIHKTIDMAREFGLEVVYGDTDSLHCKLNGKTREEALAFLKKVNDSLPGIMELELEGFYPRGIFITKKRYAMIDDEGRMVVKGLEFVRRDWAAIAKKTQEEVLKAILRDGSPEKAAEIIRKTTRDVYEGRVNLEDLIIYTQLKMPIESYKAIGPHVVAAKRLRELGHEIEPGMMIAYVEVKGPGSISERAVPVEDFKGREYDPDYYVGHQVLPAVMRIMEVLGYREIDLKFERQRQVGLDRFMK

SEQ ID NO: 2417 - protein, 806 aa, synthetic construct
  REGION 1..806: note = Description of Artificial Sequence: Synthetic polypeptide
MLLDVDYAEEEEKPSIRLFVKTGSEVLVAIDPDFEEYFYVVSDHPAKASKLIEKVEVEEDGVSIRPKGVEIVKRTFLGNEVEAIKVSFYQAKDSSKLRHKIRELPGVREIYEFDIPPARRYLIDRGLTPMAGVEFDGRIEERQGIKTVILDSPPRPAQVEEPKLNIMSFAIAVYNPTGSVRPDKDPIIMISLADNNGLRKVITWKNFERSQEYVEVVGSEREMIKRFVDLVKERDVDILLGYNTDLFDLPYIRSRAKQLKVKLDLGRDGSELVVRKRRFATASKIRGRIHVDVFAMVDFLATIGSIKLIHYSLADVYRHLLGKEKPDFEFTEMVDAWEKGGDAGRKFLEYSMSDADATLEVGLELLPLFLGLTRVVGQTLFDVQRMTPGQLVEWLLVAEAHRIGELVPGRPVGEEYEERMEETFVGAYVMEPVKGLHENLVVFDFRSAGPSIIVTHNIDPSTLNCKDCKPGEREQVPGLEYYFCRRRKGFIPATLQRIIEERMKLKAELKKLVRGTKEYRALDARQWAMKIVANSFYGMLGYPRARWYSKECAESVTSFGRHYIHKTIDMAREFGLEVVYGDTDSLHCKLNGKTREEALAFLKKVNDSLPGIMELELEGFYPRGIFITKKRYAMIDDEGRMVVKGLEFVRRDWAAIAKKTQEEVLKAILRDGSPEKAAEIIRKTTRDVYEGRVNLEDLIIYTQLKMPIESYKAIGPHVVAAKRLRELGHEIEPGMMIAYVEVKGPGSISERAVPVEDFKGREYDPDYYVGHQVLPAVMRIMEVLGYREIDLKFERQRQVGLDRFMK

SEQ ID NO: 2418 - protein, 806 aa, synthetic construct
  REGION 1..806: note = Description of Artificial Sequence: Synthetic polypeptide
MLLDVDYAEEEEKPSIRLFVKTGSEVLVAIDPDFEEYFYVVSDHPAKASKLIEKVEVEEDGVSIRPKGVEIVKRTFLGNEVEAIKVSFYQAKDSSKLRHKIRELPGVREIYEFDIPPARRYLIDRGLTPMAGVEFDGRIEERQGIKTVILDSPPRPAQVEEPKLNIMSFAIAVYNPTGSVRPDKDPIIMISLADNNGLRKVITWKNFERSQEYVEVVGSEREMIKRFVDLVKERDVDILLGYNTDLFDLPYIRSRAKQLKVKLDLGRDGSELVVRKRRFATASKIRGRIHVDVFAMVDFLATIGSIKLIHYSLADVYRHLLGKEKPDFEFTEMVDAWEKGGDAGRKFLEYSMSDADATLEVGLELLPLFLGLTRVVGQTLFDVQRMTPGQLVEWLLVAEAHRIGELVPGRPVGEEYEERMEETFVGAYVMEPVKGLHENLVVFDFRSYAASIIVTHNIDPSTLNCKDCKPGEREQVPGLEYYFCRRRKGFIPATLQRIIEERMKLKAELKKLVRGTKEYRALDARQWAMKIVANSFYGMLGYPRARWYSKECAESVTSFGRHYIHKTIDMAREFGLEVVYGDTDSLHCKLNGKTREEALAFLKKVNDSLPGIMELELEGFYPRGIFITKKRYAMIDDEGRMVVKGLEFVRRDWAAIAKKTQEEVLKAILRDGSPEKAAEIIRKTTRDVYEGRVNLEDLIIYTQLKMPIESYKAIGPHVVAAKRLRELGHEIEPGMMIAYVEVKGPGSISERAVPVEDFKGREYDPDYYVGHQVLPAVMRIMEVLGYREIDLKFERQRQVGLDRFMK

SEQ ID NO: 2419 - protein, 806 aa, synthetic construct
  REGION 1..806: note = Description of Artificial Sequence: Synthetic polypeptide
MLLDVDYAEEEEKPSIRLFVKTGSEVLVAIDPDFEEYFYVVSDHPAKASKLIEKVEVEEDGVSIRPKGVEIVKRTFLGNEVEAIKVSFYQAKDSSKLRHKIRELPGVREIYEFDIPPARRYLIDRGLTPMAGVEFDGRIEERQGIKTVILDSPPRPAQVEEPKLNIMSFAIAVYNPTGSVRPDKDPIIMISLADNNGLRKVITWKNFERSQEYVEVVGSEREMIKRFVDLVKERDVDILLGYNTDLFDLPYIRSRAKQLKVKLDLGRDGSELVVRKRRFATASKIRGRIHVDVFAMVDFLATIGSIKLIHYSLADVYRHLLGKEKPDFEFTEMVDAWEKGGDAGRKFLEYSMSDADATLEVGLELLPLFLGLTRVVGQTLFDVQRMTPGQLVEWLLVAEAHRIGELVPGRPVGEEYEERMEETFVGAYVMEPVKGLHENLVVFDFRSFGPSIIVTHNIDPSTLNCKDCKPGEREQVPGLEYYFCRRRKGFIPATLQRIIEERMKLKAELKKLVRGTKEYRALDARQWAMKIVANSFYGMLGYPRARWYSKECAESVTSFGRHYIHKTIDMAREFGLEVVYGDTDSLHCKLNGKTREEALAFLKKVNDSLPGIMELELEGFYPRGIFITKKRYAMIDDEGRMVVKGLEFVRRDWAAIAKKTQEEVLKAILRDGSPEKAAEIIRKTTRDVYEGRVNLEDLIIYTQLKMPIESYKAIGPHVVAAKRLRELGHEIEPGMMIAYVEVKGPGSISERAVPVEDFKGREYDPDYYVGHQVLPAVMRIMEVLGYREIDLKFERQRQVGLDRFMK

SEQ ID NO: 2420 - protein, 806 aa, synthetic construct
  REGION 1..806: note = Description of Artificial Sequence: Synthetic polypeptide
MLLDVDYAEEEEKPSIRLFVKTGSEVLVAIDPDFEEYFYVVSDHPAKASKLIEKVEVEEDGVSIRPKGVEIVKRTFLGNEVEAIKVSFYQAKDSSKLRHKIRELPGVREIYEFDIPPARRYLIDRGLTPMAGVEFDGRIEERQGIKTVILDSPPRPAQVEEPKLNIMSFAIAVYNPTGSVRPDKDPIIMISLADNNGLRKVITWKNFERSQEYVEVVGSEREMIKRFVDLVKERDVDILLGYNTDLFDLPYIRSRAKQLKVKLDLGRDGSELVVRKRRFATASKIRGRIHVDVFAMVDFLATIGSIKLIHYSLADVYRHLLGKEKPDFEFTEMVDAWEKGGDAGRKFLEYSMSDADATLEVGLELLPLFLGLTRVVGQTLFDVQRMTPGQLVEWLLVAEAHRIGELVPGRPVGEEYEERMEETFVGAYVMEPVKGLHENLVVFDFRSFGASIIVTHNIDPSTLNCKDCKPGEREQVPGLEYYFCRRRKGFIPATLQRIIEERMKLKAELKKLVRGTKEYRALDARQWAMKIVANSFYGMLGYPRARWYSKECAESVTSFGRHYIHKTIDMAREFGLEVVYGDTDSLHCKLNGKTREEALAFLKKVNDSLPGIMELELEGFYPRGIFITKKRYAMIDDEGRMVVKGLEFVRRDWAAIAKKTQEEVLKAILRDGSPEKAAEIIRKTTRDVYEGRVNLEDLIIYTQLKMPIESYKAIGPHVVAAKRLRELGHEIEPGMMIAYVEVKGPGSISERAVPVEDFKGREYDPDYYVGHQVLPAVMRIMEVLGYREIDLKFERQRQVGLDRFMK

SEQ ID NO: 2421 - protein, 806 aa, synthetic construct
  REGION 1..806: note = Description of Artificial Sequence: Synthetic polypeptide
MLLDVDYAEEEEKPSIRLFVKTGSEVLVAIDPDFEEYFYVVSDHPAKASKLIEKVEVEEDGVSIRPKGVEIVKRTFLGNEVEAIKVSFYQAKDSSKLRHKIRELPGVREIYEFDIPPARRYLIDRGLTPMAGVEFDGRIEERQGIKTVILDSPPRPAQVEEPKLNIMSFAIAVYNPTGSVRPDKDPIIMISLADNNGLRKVITWKNFERSQEYVEVVGSEREMIKRFVDLVKERDVDILLGYNTDLFDLPYIRSRAKQLKVKLDLGRDGSELVVRKRRFATASKIRGRIHVDVFAMVDFLATIGSIKLIHYSLADVYRHLLGKEKPDFEFTEMVDAWEKGGDAGRKFLEYSMSDADATLEVGLELLPLFLGLTRVVGQTLFDVQRMTPGQLVEWLLVAEAHRIGELVPGRPVGEEYEERMEETFVGAYVMEPVKGLHENLVVFDFRSFAASIIVTHNIDPSTLNCKDCKPGEREQVPGLEYYFCRRRKGFIPATLQRIIEERMKLKAELKKLVRGTKEYRALDARQWAMKIVANSFYGMLGYPRARWYSKECAESVTSFGRHYIHKTIDMAREFGLEVVYGDTDSLHCKLNGKTREEALAFLKKVNDSLPGIMELELEGFYPRGIFITKKRYAMIDDEGRMVVKGLEFVRRDWAAIAKKTQEEVLKAILRDGSPEKAAEIIRKTTRDVYEGRVNLEDLIIYTQLKMPIESYKAIGPHVVAAKRLRELGHEIEPGMMIAYVEVKGPGSISERAVPVEDFKGREYDPDYYVGHQVLPAVMRIMEVLGYREIDLKFERQRQVGLDRFMK

SEQ ID NO: 2422 - protein, 806 aa, synthetic construct
  REGION 1..806: note = Description of Artificial Sequence: Synthetic polypeptide
MLLDVDYAEEEEKPSIRLFVKTGSEVLVAIDPDFEEYFYVVSDHPAKASKLIEKVEVEEDGVSIRPKGVEIVKRTFLGNEVEAIKVSFYQAKDSSKLRHKIRELPGVREIYEFDIPPARRYLIDRGLTPMAGVEFDGRIEERQGIKTVILDSPPRPAQVEEPKLNIMSFAIAVYNPTGSVRPDKDPIIMISLADNNGLRKVITWKNFERSQEYVEVVGSEREMIKRFVDLVKERDVDILLGYNTDLFDLPYIRSRAKQLKVKLDLGRDGSELVVRKRRFATASKIRGRIHVDVFAMVDFLATIGSIKLIHYSLADVYRHLLGKEKPDFEFTEMVDAWEKGGDAGRKFLEYSMSDADATLEVGLELLPLFLGLTRVVGQTLFDVQRMTPGQLVEWLLVAEAHRIGELVPGRPVGEEYEERMEETFVGAYVMEPVKGLHENLVVFDFRSFAGSIIVTHNIDPSTLNCKDCKPGEREQVPGLEYYFCRRRKGFIPATLQRIIEERMKLKAELKKLVRGTKEYRALDARQWAMKIVANSFYGMLGYPRARWYSKECAESVTSFGRHYIHKTIDMAREFGLEVVYGDTDSLHCKLNGKTREEALAFLKKVNDSLPGIMELELEGFYPRGIFITKKRYAMIDDEGRMVVKGLEFVRRDWAAIAKKTQEEVLKAILRDGSPEKAAEIIRKTTRDVYEGRVNLEDLIIYTQLKMPIESYKAIGPHVVAAKRLRELGHEIEPGMMIAYVEVKGPGSISERAVPVEDFKGREYDPDYYVGHQVLPAVMRIMEVLGYREIDLKFERQRQVGLDRFMK

SEQ ID NO: 2423 - protein, 806 aa, synthetic construct
  REGION 1..806: note = Description of Artificial Sequence: Synthetic polypeptide
MLLDVDYAEEEEKPSIRLFVKTGSEVLVAIDPDFEEYFYVVSDHPAKASKLIEKVEVEEDGVSIRPKGVEIVKRTFLGNEVEAIKVSFYQAKDSSKLRHKIRELPGVREIYEFDIPPARRYLIDRGLTPMAGVEFDGRIEERQGIKTVILDSPPRPAQVEEPKLNIMSFAIAVYNPTGSVRPDKDPIIMISLADNNGLRKVITWKNFERSQEYVEVVGSEREMIKRFVDLVKERDVDILLGYNTDLFDLPYIRSRAKQLKVKLDLGRDGSELVVRKRRFATASKIRGRIHVDVFAMVDFLATIGSIKLIHYSLADVYRHLLGKEKPDFEFTEMVDAWEKGGDAGRKFLEYSMSDADATLEVGLELLPLFLGLTRVVGQTLFDVQRMTPGQLVEWLLVAEAHRIGELVPGRPVGEEYEERMEETFVGAYVMEPVKGLHENLVVFDFRSYGASIIVTHNIDPSTLNCKDCKPGEREQVPGLEYYFCRRRKGFIPATLQRIIEERMKLKAELKKLVRGTKEYRALDARQWAMKIVANSFYGMLGYPRARWYSKECAESVTSFGRHYIHKTIDMAREFGLEVVYGDTDSLHCKLNGKTREEALAFLKKVNDSLPGIMELELEGFYPRGIFITKKRYAMIDDEGRMVVKGLEFVRRDWAAIAKKTQEEVLKAILRDGSPEKAAEIIRKTTRDVYEGRVNLEDLIIYTQLKMPIESYKAIGPHVVAAKRLRELGHEIEPGMMIAYVEVKGPGSISERAVPVEDFKGREYDPDYYVGHQVLPAVMRIMEVLGYREIDLKFERQRQVGLDRFMK

SEQ ID NO: 2424 - protein, 806 aa, synthetic construct
  REGION 1..806: note = Description of Artificial Sequence: Synthetic polypeptide
MLLDVDYAEEEEKPSIRLFVKTGSEVLVAIDPDFEEYFYVVSDHPAKASKLIEKVEVEEDGVSIRPKGVEIVKRTFLGNEVEAIKVSFYQAKDSSKLRHKIRELPGVREIYEFDIPPARRYLIDRGLTPMAGVEFDGRIEERQGIKTVILDSPPRPAQVEEPKLNIMSFAIAVYNPTGSVRPDKDPIIMISLADNNGLRKVITWKNFERSQEYVEVVGSEREMIKRFVDLVKERDVDILLGYNTDLFDLPYIRSRAKQLKVKLDLGRDGSELVVRKRRFATASKIRGRIHVDVFAMVDFLATIGSIKLIHYSLADVYRHLLGKEKPDFEFTEMVDAWEKGGDAGRKFLEYSMSDADATLEVGLELLPLFLGLTRVVGQTLFDVQRMTPGQLVEWLLVAEAHRIGELVPGRPVGEEYEERMEETFVGAYVMEPVKGLHENLVVFDFRSYGPSIIVTHNIDPSTLNCKDCKPGEREQVPGLEYYFCRRRKGFIPATLQRIIEERMKLKAELKKLVRGTKEYRALDARQWAMKIVANSFYGMLGYPRARWYSKECAESVTSFGRHYIHKTIDMAREFGLEVVYGDTDSLHCKLNGKTREEALAFLKKVNDSLPGIMELELEGFYPRGIFITKKRYAMIDDEGRMVVKGLEFVRRDWAAIAKKTQEEVLKAILRDGSPEKAAEIIRKTTRDVYEGRVNLEDLIIYTQLKMPIESYKAIGPHVVAAKRLRELGHEIEPGMMIAYVEVKGPGSISERAVPVEDFKGREYDPDYYVGHQVLPAVMRIMEVLGYREIDLKFERQRQVGLDRFMK

SEQ ID NO: 2425 - protein, 806 aa, synthetic construct
  REGION 1..806: note = Description of Artificial Sequence: Synthetic polypeptide
MLLDVDYAEEEEKPSIRLFVKTGSEVLVAIDPDFEEYFYVVSDHPAKASKLIEKVEVEEDGVSIRPKGVEIVKRTFLGNEVEAIKVSFYQAKDSSKLRHKIRELPGVREIYEFDIPPARRYLIDRGLTPMAGVEFDGRIEERQGIKTVILDSPPRPAQVEEPKLNIMSFAIAVYNPTGSVRPDKDPIIMISLADNNGLRKVITWKNFERSQEYVEVVGSEREMIKRFVDLVKERDVDILLGYNTDLFDLPYIRSRAKQLKVKLDLGRDGSELVVRKRRFATASKIRGRIHVDVFAMVDFLATIGSIKLIHYSLADVYRHLLGKEKPDFEFTEMVDAWEKGGDAGRKFLEYSMSDADATLEVGLELLPLFLGLTRVVGQTLFDVQRMTPGQLVEWLLVAEAHRIGELVPGRPVGEEYEERMEETFVGAYVMEPVKGLHENLVVFDFRSYAGSIIVTHNIDPSTLNCKDCKPGEREQVPGLEYYFCRRRKGFIPATLQRIIEERMKLKAELKKLVRGTKEYRALDARQWAMKIVANSFYGMLGYPRARWYSKECAESVASFGRHYIHKTIDMAREFGLEVVYGDTDSLHCKLNGKTREEALAFLKKVNDSLPGIMELELEGFYPRGIFITKKRYAMIDDEGRMVVKGLEFVRRDWAAIAKKTQEEVLKAILRDGSPEKAAEIIRKTTRDVYEGRVNLEDLIIYTQLKMPIESYKAIGPHVVAAKRLRELGHEIEPGMMIAYVEVKGPGSISERAVPVEDFKGREYDPDYYVGHQVLPAVMRIMEVLGYREIDLKFERQRQVGLDRFMK

SEQ ID NO: 2426 - protein, 806 aa, synthetic construct
  REGION 1..806: note = Description of Artificial Sequence: Synthetic polypeptide
MLLDVDYAEEEEKPSIRLFVKTGSEVLVAIDPDFEEYFYVVSDHPAKASKLIEKVEVEEDGVSIRPKGVEIVKRTFLGNEVEAIKVSFYQAKDSSKLRHKIRELPGVREIYEFDIPPARRYLIDRGLTPMAGVEFDGRIEERQGIKTVILDSPPRPAQVEEPKLNIMSFAIAVYNPTGSVRPDKDPIIMISLADNNGLRKVITWKNFERSQEYVEVVGSEREMIKRFVDLVKERDVDILLGYNTDLFDLPYIRSRAKQLKVKLDLGRDGSELVVRKRRFATASKIRGRIHVDVFAMVDFLATIGSIKLIHYSLADVYRHLLGKEKPDFEFTEMVDAWEKGGDAGRKFLEYSMSDADATLEVGLELLPLFLGLTRVVGQTLFDVQRMTPGQLVEWLLVAEAHRIGELVPGRPVGEEYEERMEETFVGAYVMEPVKGLHENLVVFDFRSSAASIIVTHNIDPSTLNCKDCKPGEREQVPGLEYYFCRRRKGFIPATLQRIIEERMKLKAELKKLVRGTKEYRALDARQWAMKIVANSFYGMLGYPRARWYSKECAESVTSFGRHYIHKTIDMAREFGLEVVYGDTDSLHCKLNGKTREEALAFLKKVNDSLPGIMELELEGFYPRGIFITKKRYAMIDDEGRMVVKGLEFVRRDWAAIAKKTQEEVLKAILRDGSPEKAAEIIRKTTRDVYEGRVNLEDLIIYTQLKMPIESYKAIGPHVVAAKRLRELGHEIEPGMMIAYVEVKGPGSISERAVPVEDFKGREYDPDYYVGHQVLPAVMRIMEVLGYREIDLKFERQRQVGLDRFMK

SEQ ID NO: 2427 - protein, 806 aa, synthetic construct
  REGION 1..806: note = Description of Artificial Sequence: Synthetic polypeptide
MLLDVDFAEEEEKPSIRLFVKTGSEVLVAIDPDFEEYFYVVSDHPAKASKLIEKVEVEEDGVSIRPKGVEIVKRTFLGNEVEAIKVSFYQAKDSSKLRHKIRELPGVREIYEFDIPPARRYLIDRGLTPMAGVEFDGRIEERQGIKTVILDSPPRPAQVEEPKLNIMSFAIAVYNPTGSVRPDKDPIIMISLADNNGLRKVITWKNFERSQEYVEVVGSEREMIKRFVDLVKERDVDILLGYNTDLFDLPYIRSRAKQLKVKLDLGRDGSELVVRKRRFATASKIRGRIHVDVFAMVDFLATIGSIKLIHYSLADVYRHLLGKEKPDFEFTEMVDAWEKGGDAGRKFLEYSMSDADATLEVGLELLPLFLGLTRVVGQTLFDVQRMTPGQLVEWLLVAEAHRIGELVPGRPVGEEYEERMEETFVGAYVMEPVKGLHENLVVFDFRSYGPSIIVTHNIDPSTLNCKDCKPGEREQVPGLEYYFCRRRKGFIPATLQRIIEERMKLKAELKKLVRGTKEYRALDARQWAMKIVANSFYGMLGYPRARWYSKECAESVSSFGRHYIHKTIDMAREFGLEVVYGDTDSLHCKLNGKTREEALAFLKKVNDSLPGIMELELEGFYPRGIFITKKRYAMIDDEGRMVVKGLEFVRRDWAAIAKKTQEEVLKAILRDGSPEKAAEIIRKTTRDVYEGRVNLEDLIIYTQLKMPIESYKAIGPHVVAAKRLRELGHEIEPGMMIAYVEVKGPGSISERAVPVEDFKGREYDPDYYVGHQVLPAVMRIMEVLGYREIDLKFERQRQVGLDRFMK

SEQ ID NO: 2428 - protein, 806 aa, synthetic construct
  REGION 1..806: note = Description of Artificial Sequence: Synthetic polypeptide
MLLDVDYAEEEEKPSIRLFVKTGSEVLVAIDPDFEEYFYVVSDHPAKASKLIEKVEVEEDGVSIRPKGVEIVKRTFLGNEVEAIKVSFYQAKDSSKLRHKIRELPGVREIYEFDIPPARRYLIDRGLTPMAGVEFDGRIEERQGIKTVILDSPPRPAQVEEPKLNIMSFAIAVYNPTGSVRPDKDPIIMISLADNNGLRKVITWKNFERSQEYVEVVGSEREMIKRFVDLVKERDVDILLGYNTDLFDLPYIRSRAKQLKVKLDLGRDGSELVVRKRRFATASKIRGRIHVDVFAMVDFLATIGSIKLIHYSLADVYRHLLGKEKPDFEFTEMVDAWEKGGDAGRKFLEYSMSDADATLEVGLELLPLFLGLTRVVGQTLFDVQRMTPGQLVEWLLVAEAHRIGELVPGRPVGEEYEERMEETFVGAYVMEPVKGLHENLVVFDFRSSAGSIIVTHNIDPSTLNCKDCKPGEREQVPGLEYYFCRRRKGFIPATLQRIIEERMKLKAELKKLVRGTKEYRALDARQWAMKIVANSFYGMLGYPRARWYSKECAESVTSFGRHYIHKTIDMAREFGLEVVYGDTDSLHCKLNGKTREEALAFLKKVNDSLPGIMELELEGFYPRGIFITKKRYAMIDDEGRMVVKGLEFVRRDWAAIAKKTQEEVLKAILRDGSPEKAAEIIRKTTRDVYEGRVNLEDLIIYTQLKMPIESYKAIGPHVVAAKRLRELGHEIEPGMMIAYVEVKGPGSISERAVPVEDFKGREYDPDYYVGHQVLPAVMRIMEVLGYREIDLKFERQRQVGLDRFMK

SEQ ID NO: 2429 - protein, 806 aa, synthetic construct
  REGION 1..806: note = Description of Artificial Sequence: Synthetic polypeptide
MLLDVDYAEEEEKPSIRLFVKTGSEVLVAIDPDFEEYFYVVSDHPAKASKLIEKVEVEEDGVSIRPKGVEIVKRTFLGNEVEAIKVSFYQAKDSSKLRHKIRELPGVREIYEFDIPPARRYLIDRGLTPMAGVEFDGRIEERQGIKTVILDSPPRPAQVEEPKLNIMSFAIAVYNPTGSVRPDKDPIIMISLADNNGLRKVITWKNFERSQEYVEVVGSEREMIKRFVDLVKERDVDILLGYNTDLFDLPYIRSRAKQLKVKLDLGRDGSELVVRKRRFATASKIRGRIHVDVFAMVDFLATIGSIKLIHYSLADVYRHLLGKEKPDFEFTEMVDAWEKGGDAGRKFLEYSMSDADATLEVGLELLPLFLGLTRVVGQTLFDVQRMTPGQLVEWLLVAEAHRIGELVPGRPVGEEYEERMEETFVGAYVMEPVKGLHENLVVFDFRSLAPSIIVTHNIDPSTLNCKDCKPGEREQVPGLEYYFCRRRKGFIPATLQRIIEERMKLKAELKKLVRGTKEYRALDARQWAMKIVANSFYGMLGYPRARWYSKECAESVTSFGRHYIHKTIDMAREFGLEVVYGDTDSLHCKLNGKTREEALAFLKKVNDSLPGIMELELEGFYPRGIFITKKRYAMIDDEGRMVVKGLEFVRRDWAAIAKKTQEEVLKAILRDGSPEKAAEIIRKTTRDVYEGRVNLEDLIIYTQLKMPIESYKAIGPHVVAAKRLRELGHEIEPGMMIAYVEVKGPGSISERAVPVEDFKGREYDPDYYVGHQVLPAVMRIMEVLGYREIDLKFERQRQVGLDRFMK

SEQ ID NO: 2430 - protein, 806 aa, synthetic construct
  REGION 1..806: note = Description of Artificial Sequence: Synthetic polypeptide
MLLDVDFAEEEEKPSIRLFVKTGSEVLVAIDPDFEEYFYVVSDHPAKASKLIEKVEVEEDGVSIRPKGVEIVKRTFLGNEVEAIKVSFYQAKDSSKLRHKIRELPGVREIYEFDIPPARRYLIDRGLTPMAGVEFDGRIEERQGIKTVILDSPPRPAQVEEPKLNIMSFAIAVYNPTGSVRPDKDPIIMISLADNNGLRKVITWKNFERSQEYVEVVGSEREMIKRFVDLVKERDVDILLGYNTDLFDLPYIRSRAKQLKVKLDLGRDGSELVVRKRRFATASKIRGRIHVDVFAMVDFLATIGSIKLIHYSLADVYRHLLGKEKPDFEFTEMVDAWEKGGDAGRKFLEYSMSDADATLEVGLELLPLFLGLTRVVGQTLFDVQRMTPGQLVEWLLVAEAHRIGELVPGRPVGEEYEERMEETFVGAYVMEPVKGLHENLVVFDFRSSAPSIIVTHNIDPSTLNCKDCKPGEREQVPGLEYYFCRRRKGFIPATLQRIIEERMKLKAELKKLVRGTKEYRALDARQWAMKIVANSFYGMLGYPRARWYSKECAESVTSFGRHYIHKTIDMAREFGLEVVYGDTDSLHCKLNGKTREEALAFLKKVNDSLPGIMELELEGFYPRGIFITKKRYAMIDDEGRMVVKGLEFVRRDWAAIAKKTQEEVLKAILRDGSPEKAAEIIRKTTRDVYEGRVNLEDLIIYTQLKMPIESYKAIGPHVVAAKRLRELGHEIEPGMMIAYVEVKGPGSISERAVPVEDFKGREYDPDYYVGHQVLPAVMRIMEVLGYREIDLKFERQRQVGLDRFMK

SEQ ID NO: 2431 - protein, 806 aa, synthetic construct
  REGION 1..806: note = Description of Artificial Sequence: Synthetic polypeptide
MLLDVDYAEEEEKPSIRLFVKTGSEVLVAIDPDFEEYFYVVSDHPAKASKLIEKVEVEEDGVSIRPKGVEIVKRTFLGNEVEAIKVSFYQAKDSSKLRHKIRELPGVREIYEFDIPPARRYLIDRGLTPMAGVEFDGRIEERQGIKTVILDSPPRPAQVEEPKLNIMSFAIAVYNPTGSVRPDKDPIIMISLADNNGLRKVITWKNFERSQEYVEVVGSEREMIKRFVDLVKERDVDILLGYNTDLFDLPYIRSRAKQLKVKLDLGRDGSELVVRKRRFATASKIRGRIHVDVFAMVDFLATIGSIKLIHYSLADVYRHLLGKEKPDFEFTEMVDAWEKGGDAGRKFLEYSMSDADATLEVGLELLPLFLGLTRVVGQTLFDVQRMTPGQLVEWLLVAEAHRIGELVPGRPVGEEYEERMEETFVGAYVMEPVKGLHENLVVFDFRSYAGSIIVTHNIDPSTLNCKDCKPGEREQVPGLEYYFCRRRKGFIPATLQRIIEERMKLKAELKKLVRGTKEYRALDARQWAMKIVANSFYGMLGYPRARWYSKECAESVSSFGRHYIHKTIDMAREFGLEVVYGDTDSLHCKLNGKTREEALAFLKKVNDSLPGIMELELEGFYPRGIFITKKRYAMIDDEGRMVVKGLEFVRRDWAAIAKKTQEEVLKAILRDGSPEKAAEIIRKTTRDVYEGRVNLEDLIIYTQLKMPIESYKAIGPHVVAAKRLRELGHEIEPGMMIAYVEVKGPGSISERAVPVEDFKGREYDPDYYVGHQVLPAVMRIMEVLGYREIDLKFERQRQVGLDRFMK

SEQ ID NO: 2432 - protein, 806 aa, synthetic construct
  REGION 1..806: note = Description of Artificial Sequence: Synthetic polypeptide
MLLDVDYAEEEEKPSIRLFVKTGSEVLVAIDPDFEEYFYVVSDHPAKASKLIEKVEVEEDGVSIRPKGVEIVKRTFLGNEVEAIKVSFYQAKDSSKLRHKIRELPGVREIYEFDIPPARRYLIDRGLTPMAGVEFDGRIEERQGIKTVILDSPPRPAQVEEPKLNIMSFAIAVYNPTGSVRPDKDPIIMISLADNNGLRKVITWKNFERSQEYVEVVGSEREMIKRFVDLVKERDVDILLGYNTDLFDLPYIRSRAKQLKVKLDLGRDGSELVVRKRRFATASKIRGRIHVDVFAMVDFLATIGSIKLIHYSLADVYRHLLGKEKPDFEFTEMVDAWEKGGDAGRKFLEYSMSDADATLEVGLELLPLFLGLTRVVGQTLFDVQRMTPGQLVEWLLVAEAHRIGELVPGRPVGEEYEERMEETFVGAYVMEPVKGLHENLVVFDFRSSAPSIIVTHNIDPSTLNCKDCKPGEREQVPGLEYYFCRRRKGFIPATLQRIIEERMKLKAELKKLVRGTKEYRALDARQWAMKIVANSFYGMLGYPRARWYSKECAESVTSFGRHYIHKTIDMAREFGLEVVYGDTDSLHCKLNGKTREEALAFLKKVNDSLPGIMELELEGFYPRGIFITKKRYAMIDDEGRMVVKGLEFVRRDWAAIAKKTQEEVLKAILRDGSPEKAAEIIRKTTRDVYEGRVNLEDLIIYTQLKMPIESYKAIGPHVVAAKRLRELGHEIEPGMMIAYVEVKGPGSISERAVPVEDFKGREYDPDYYVGHQVLPAVMRIMEVLGYREIDLKFERQRQVGLDRFMK

SEQ ID NO: 2433 - protein, 806 aa, synthetic construct
  REGION 1..806: note = Description of Artificial Sequence: Synthetic polypeptide
MLLDVDYAEEEEKPSIRLFVKTGSEVLVAIDPDFEEYFYVVSDHPAKASKLIEKVEVEEDGVSIRPKGVEIVKRTFLGNEVEAIKVSFYQAKDSSKLRHKIRELPGVREIYEFDIPPARRYLIDRGLTPMAGVEFDGRIEERQGIKTVILDSPPRPAQVEEPKLNIMSFAIAVYNPTGSVRPDKDPIIMISLADNNGLRKVITWKNFERSQEYVEVVGSEREMIKRFVDLVKERDVDILLGYNTDLFDLPYIRSRAKQLKVKLDLGRDGSELVVRKRRFATASKIRGRIHVDVFAMVDFLATIGSIKLIHYSLADVYRHLLGKEKPDFEFTEMVDAWEKGGDAGRKFLEYSMSDADATLEVGLELLPLFLGLTRVVGQTLFDVQRMTPGQLVEWLLVAEAHRIGELVPGRPVGEEYEERMEETFVGAYVMEPVKGLHENLVVFDFRSYGPSIIVTHNIDPSTLNCKDCKPGEREQVPGLEYYFCRRRKGFIPATLQRIIEERMKLKAELKKLVRGTKEYRALDARQWAMKIVANSFYGMLGYPRARWYSKECAESVSSFGRHYIHKTIDMAREFGLEVVYGDTDSLHCKLNGKTREEALAFLKKVNDSLPGIMELELEGFYPRGIFITKKRYAMIDDEGRMVVKGLEFVRRDWAAIAKKTQEEVLKAILRDGSPEKAAEIIRKTTRDVYEGRVNLEDLIIYTQLKMPIESYKAIGPHVVAAKRLRELGHEIEPGMMIAYVEVKGPGSISERAVPVEDFKGREYDPDYYVGHQVLPAVMRIMEVLGYREIDLKFERQRQVGLDRFMK

SEQ ID NO: 2434 - protein, 806 aa, synthetic construct
  REGION 1..806: note = Description of Artificial Sequence: Synthetic polypeptide
MLLDVDYAEEEEKPSIRLFVKTGSEVLVAIDPDFEEYFYVVSDHPAKASKLIEKVEVEEDGVSIRPKGVEIVKRTFLGNEVEAIKVSFYQAKDSSKLRHKIRELPGVREIYEFDIPPARRYLIDRGLTPMAGVEFDGRIEERQGIKTVILDSPPRPAQVEEPKLNIMSFAIAVYNPTGSVRPDKDPIIMISLADNNGLRKVITWKNFERSQEYVEVVGSEREMIKRFVDLVKERDVDILLGYNTDLFDLPYIRSRAKQLKVKLDLGRDGSELVVRKRRFATASKIRGRIHVDVFAMVDFLATIGSIKLIHYSLADVYRHLLGKEKPDFEFTEMVDAWEKGGDAGRKFLEYSMSDADATLEVGLELLPLFLGLTRVVGQTLFDVQRMTPGQLVEWLLVAEAHRIGELVPGRPVGEEYEERMEETFVGAYVMEPVKGLHENLVVFDFRSYAGSIIVTHNIDPSTLNCKDCKPGEREQVPGLEYYFCRRRKGFIPATLQRIIEERMKLKAELKKLVRGTKEYRALDARQWAMKIVANSFYGMLGYPRARWYSKECAESVSAFGRHYIHKTIDMAREFGLEVVYGDTDSLHCKLNGKTREEALAFLKKVNDSLPGIMELELEGFYPRGIFITKKRYAMIDDEGRMVVKGLEFVRRDWAAIAKKTQEEVLKAILRDGSPEKAAEIIRKTTRDVYEGRVNLEDLIIYTQLKMPIESYKAIGPHVVAAKRLRELGHEIEPGMMIAYVEVKGPGSISERAVPVEDFKGREYDPDYYVGHQVLPAVMRIMEVLGYREIDLKFERQRQVGLDRFMK

SEQ ID NO: 2435 - protein, 806 aa, synthetic construct
  REGION 1..806: note = Description of Artificial Sequence: Synthetic polypeptide
MLLDVDYAEEEEKPSIRLFVKTGSEVLVAIDPDFEEYFYVVSDHPAKASKLIEKVEVEEDGVSIRPKGVEIVKRTFLGNEVEAIKVSFYQAKDSSKLRHKIRELPGVREIYEFDIPPARRYLIDRGLTPMAGVEFDGRIEERQGIKTVILDSPPRPAQVEEPKLNIMSFAIAVYNPTGSVRPDKDPIIMISLADNNGLRKVITWKNFERSQEYVEVVGSEREMIKRFVDLVKERDVDILLGYNTDLFDLPYIRSRAKQLKVKLDLGRDGSELVVRKRRFATASKIRGRIHVDVFAMVDFLATIGSIKLIHYSLADVYRHLLGKEKPDFEFTEMVDAWEKGGDAGRKFLEYSMSDADATLEVGLELLPLFLGLTRVVGQTLFDVQRMTPGQLVEWLLVAEAHRIGELVPGRPVGEEYEERMEETFVGAYVMEPVKGLHENLVVFDFRSAAPSIIVTHNIDPSTLNCKDCKPGEREQVPGLEYYFCRRRKGFIPATLQRIIEERMKLKAELKKLVRGTKEYRALDARQWAMKIVANSFYGMLGYPRARWYSKECAESVTSFGRHYIHKTIDMAREFGLEVVYGDTDSLHCKLNGKTREEALAFLKKVNDSLPGIMELELEGFYPRGIFITKKRYAMIDDEGRMVVKGLEFVRRDWAAIAKKTQEEVLKAILRDGSPEKAAEIIRKTTRDVYEGRVNLEDLIIYTQLKMPIESYKAIGPHVVAAKRLRELGHEIEPGMMIAYVEVKGPGSISERAVPVEDFKGREYDPDYYVGHQVLPAVMRIMEVLGYREIDLKFERQRQVGLDRFMK

SEQ ID NO: 2436 - protein, 687 aa, unidentified
  REGION 1..687: note = Description of Unknown: Euryarchaeota archaeon sequence
MDGFLLDVDYKTVDEKPVVRLFLRDVIALDPSFRPYVYVACDDPRAVAGEIKDLELDGRRPVTGVEEMERGLLGRPRRFLKVYLGHPQQVPRVRDLLRRLPGVSAVLEDDILFSRRYLIDKGLVPTAWVELQGRVEGSEFWVEEVRRAEGPLPRLKVMSFDIETYNPKGAPRGDQDPIIMVSMATSGGLRKVLSWKAPTAGLEFVETLEDEAAVLRRFEELVRQEDPDILVGYNTDNFDFPYLNQRLKALGIELALGRDGSPHKTSTRMGMSETRMAGRPHMDLYPIVRRSLRLPSYVLEDVVAEVLGEEKEKVPGERMGEIWDKGGEELDRFFRYSLEDAEVTLRIGEKYLPLYIELSRLVGQSIHDVARMTAGQLVEWYLMREAFARGEVIPERPGGREFARRAGDTYEGGYVREPRKGLLEKVFDFRSLYPSVIVTHNIDPSTIRPGPGENQPPGIDYHFTTEKEGFIPALLKRLVARRAELKEEMKKARDPGERKMLDVQQQALKILANSFYGYMGYPRARWYRKECAESVTAFARDYIKKVMEVAEKEFGLEVVYGDTDSLFILVPGGKKERAFAFLEEVNRRLPGTIELEYEGFYRRGIFVTKKRYALIDEKDRIIVKGLEFVRRDWAPIARDTQEKVLKALLKDASPEEAVRIVRKAMDDIRARRVSLEDLTIYTQLTKK

SEQ ID NO: 2437 - protein, 687 aa, synthetic construct
  REGION 1..687: note = Description of Artificial Sequence: Synthetic polypeptide
MDGFLLDVDFKTVDEKPVVRLFLRDVIALDPSFRPYVYVAADDPRAVAGEIKDLELDGRRPVTGVEEMERGLLGRPRRFLKVYLGHPQQVPRVRDLLRRLPGVSAVLEDDILFSRRYLIDKGLVPTAWVELQGRVEGSEFWVEEVRRAEGPLPRLKVMSFAIATYNPKGAPRGDQDPIIMVSMATSGGLRKVLSWKAPTAGLEFVETLEDEAAVLRRFEELVRQEDPDILVGYNTDNFDFPYLNQRLKALGIELALGRDGSPHKTSTRMGMSETRMAGRPHMDLYPIVRRSLRLPSYVLEDVVAEVLGEEKEKVPGERMGEIWDKGGEELDRFFRYSLEDAEVTLRIGEKYLPLYIELSRLVGQSIHDVARMTAGQLVEWYLMREAFARGEVIPERPGGREFARRAGDTYEGGYVREPRKGLLEKVFDFRSFAGSVIVTHNIDPSTIRPGPGENQPPGIDYHFTTEKEGFIPALLKRLVARRAELKEEMKKARDPGERKMLDVQQQALKILANSFYGYMGYPRARWYRKEAAESVSAFARDYIKKVMEVAEKEFGLEVVYGDTDSLFILVPGGKKERAFAFLEEVNRRLPGTIELEYEGFYRRGIFVTKKRYALIDEKDRIIVKGLEFVRRDWAPIARDTQEKVLKALLKDASPEEAVRIVRKAMDDIRARRVSLEDLTIYTQLTKK

SEQ ID NO: 2438 - protein, 687 aa, synthetic construct
  REGION 1..687: note = Description of Artificial Sequence: Synthetic polypeptide
MDGFLLDVDFKTVDEKPVVRLFLRDVIALDPSFRPYVYVAADDPRAVAGEIKDLELDGRRPVTGVEEMERGLLGRPRRFLKVYLGHPQQVPRVRDLLRRLPGVSAVLEDDILFSRRYLIDKGLVPTAWVELQGRVEGSEFWVEEVRRAEGPLPRLKVMSFAIATYNPKGAPRGDQDPIIMVSMATSGGLRKVLSWKAPTAGLEFVETLEDEAAVLRRFEELVRQEDPDILVGYNTDNFDFPYLNQRLKALGIELALGRDGSPHKTSTRMGMSETRMAGRPHMDLYPIVRRSLRLPSYVLEDVVAEVLGEEKEKVPGERMGEIWDKGGEELDRFFRYSLEDAEVTLRIGEKYLPLYIELSRLVGQSIHDVARMTAGQLVEWYLMREAFARGEVIPERPGGREFARRAGDTYEGGYVREPRKGLLEKVFDFRSYAPSVIVTHNIDPSTIRPGPGENQPPGIDYHFTTEKEGFIPALLKRLVARRAELKEEMKKARDPGERKMLDVQQQALKILANSFYGYMGYPRARWYRKEAAESVSAFARDYIKKVMEVAEKEFGLEVVYGDTDSLFILVPGGKKERAFAFLEEVNRRLPGTIELEYEGFYRRGIFVTKKRYALIDEKDRIIVKGLEFVRRDWAPIARDTQEKVLKALLKDASPEEAVRIVRKAMDDIRARRVSLEDLTIYTQLTKK

SEQ ID NO: 2439 - protein, 687 aa, synthetic construct
  REGION 1..687: note = Description of Artificial Sequence: Synthetic polypeptide
MDGFLLDVDFKTVDEKPVVRLFLRDVIALDPSFRPYVYVAADDPRAVAGEIKDLELDGRRPVTGVEEMERGLLGRPRRFLKVYLGHPQQVPRVRDLLRRLPGVSAVLEDDILFSRRYLIDKGLVPTAWVELQGRVEGSEFWVEEVRRAEGPLPRLKVMSFAIATYNPKGAPRGDQDPIIMVSMATSGGLRKVLSWKAPTAGLEFVETLEDEAAVLRRFEELVRQEDPDILVGYNTDNFDFPYLNQRLKALGIELALGRDGSPHKTSTRMGMSETRMAGRPHMDLYPIVRRSLRLPSYVLEDVVAEVLGEEKEKVPGERMGEIWDKGGEELDRFFRYSLEDAEVTLRIGEKYLPLYIELSRLVGQSIHDVARMTAGQLVEWYLMREAFARGEVIPERPGGREFARRAGDTYEGGYVREPRKGLLEKVFDFRSFGPSVIVTHNIDPSTIRPGPGENQPPGIDYHFTTEKEGFIPALLKRLVARRAELKEEMKKARDPGERKMLDVQQQALKILANSFYGYMGYPRARWYRKEAAESVSAFARDYIKKVMEVAEKEFGLEVVYGDTDSLFILVPGGKKERAFAFLEEVNRRLPGTIELEYEGFYRRGIFVTKKRYALIDEKDRIIVKGLEFVRRDWAPIARDTQEKVLKALLKDASPEEAVRIVRKAMDDIRARRVSLEDLTIYTQLTKK

SEQ ID NO: 2440 - protein, 687 aa, synthetic construct
  REGION 1..687: note = Description of Artificial Sequence: Synthetic polypeptide
MDGFLLDVDYKTVDEKPVVRLFLRDVIALDPSFRPYVYVAADDPRAVAGEIKDLELDGRRPVTGVEEMERGLLGRPRRFLKVYLGHPQQVPRVRDLLRRLPGVSAVLEDDILFSRRYLIDKGLVPTAWVELQGRVEGSEFWVEEVRRAEGPLPRLKVMSFAIATYNPKGAPRGDQDPIIMVSMATSGGLRKVLSWKAPTAGLEFVETLEDEAAVLRRFEELVRQEDPDILVGYNTDNFDFPYLNQRLKALGIELALGRDGSPHKTSTRMGMSETRMAGRPHMDLYPIVRRSLRLPSYVLEDVVAEVLGEEKEKVPGERMGEIWDKGGEELDRFFRYSLEDAEVTLRIGEKYLPLYIELSRLVGQSIHDVARMTAGQLVEWYLMREAFARGEVIPERPGGREFARRAGDTYEGGYVREPRKGLLEKVFDFRSFAGSVIVTHNIDPSTIRPGPGENQPPGIDYHFTTEKEGFIPALLKRLVARRAELKEEMKKARDPGERKMLDVQQQALKILANSFYGYMGYPRARWYRKEAAESVSAFARDYIKKVMEVAEKEFGLEVVYGDTDSLFILVPGGKKERAFAFLEEVNRRLPGTIELEYEGFYRRGIFVTKKRYALIDEKDRIIVKGLEFVRRDWAPIARDTQEKVLKALLKDASPEEAVRIVRKAMDDIRARRVSLEDLTIYTQLTKK

SEQ ID NO: 2441 - protein, 687 aa, synthetic construct
  REGION 1..687: note = Description of Artificial Sequence: Synthetic polypeptide
MDGFLLDVDFKTVDEKPVVRLFLRDVIALDPSFRPYVYVAADDPRAVAGEIKDLELDGRRPVTGVEEMERGLLGRPRRFLKVYLGHPQQVPRVRDLLRRLPGVSAVLEDDILFSRRYLIDKGLVPTAWVELQGRVEGSEFWVEEVRRAEGPLPRLKVMSFAIATYNPKGAPRGDQDPIIMVSMATSGGLRKVLSWKAPTAGLEFVETLEDEAAVLRRFEELVRQEDPDILVGYNTDNFDFPYLNQRLKALGIELALGRDGSPHKTSTRMGMSETRMAGRPHMDLYPIVRRSLRLPSYVLEDVVAEVLGEEKEKVPGERMGEIWDKGGEELDRFFRYSLEDAEVTLRIGEKYLPLYIELSRLVGQSIHDVARMTAGQLVEWYLMREAFARGEVIPERPGGREFARRAGDTYEGGYVREPRKGLLEKVFDFRSYGPSVIVTHNIDPSTIRPGPGENQPPGIDYHFTTEKEGFIPALLKRLVARRAELKEEMKKARDPGERKMLDVQQQALKILANSFYGYMGYPRARWYRKEAAESVSAFARDYIKKVMEVAEKEFGLEVVYGDTDSLFILVPGGKKERAFAFLEEVNRRLPGTIELEYEGFYRRGIFVTKKRYALIDEKDRIIVKGLEFVRRDWAPIARDTQEKVLKALLKDASPEEAVRIVRKAMDDIRARRVSLEDLTIYTQLTKK

SEQ ID NO: 2442 - protein, 687 aa, synthetic construct
  REGION 1..687: note = Description of Artificial Sequence: Synthetic polypeptide
MDGFLLDVDFKTVDEKPVVRLFLRDVIALDPSFRPYVYVAADDPRAVAGEIKDLELDGRRPVTGVEEMERGLLGRPRRFLKVYLGHPQQVPRVRDLLRRLPGVSAVLEDDILFSRRYLIDKGLVPTAWVELQGRVEGSEFWVEEVRRAEGPLPRLKVMSFAIATYNPKGAPRGDQDPIIMVSMATSGGLRKVLSWKAPTAGLEFVETLEDEAAVLRRFEELVRQEDPDILVGYNTDNFDFPYLNQRLKALGIELALGRDGSPHKTSTRMGMSETRMAGRPHMDLYPIVRRSLRLPSYVLEDVVAEVLGEEKEKVPGERMGEIWDKGGEELDRFFRYSLEDAEVTLRIGEKYLPLYIELSRLVGQSIHDVARMTAGQLVEWYLMREAFARGEVIPERPGGREFARRAGDTYEGGYVREPRKGLLEKVFDFRSSAPSVIVTHNIDPSTIRPGPGENQPPGIDYHFTTEKEGFIPALLKRLVARRAELKEEMKKARDPGERKMLDVQQQALKILANSFYGYMGYPRARWYRKEAAESVSAFARDYIKKVMEVAEKEFGLEVVYGDTDSLFILVPGGKKERAFAFLEEVNRRLPGTIELEYEGFYRRGIFVTKKRYALIDEKDRIIVKGLEFVRRDWAPIARDTQEKVLKALLKDASPEEAVRIVRKAMDDIRARRVSLEDLTIYTQLTKK

SEQ ID NO: 2443 - protein, 687 aa, synthetic construct
  REGION 1..687: note = Description of Artificial Sequence: Synthetic polypeptide
MDGFLLDVDYKTVDEKPVVRLFLRDVIALDPSFRPYVYVAADDPRAVAGEIKDLELDGRRPVTGVEEMERGLLGRPRRFLKVYLGHPQQVPRVRDLLRRLPGVSAVLEDDILFSRRYLIDKGLVPTAWVELQGRVEGSEFWVEEVRRAEGPLPRLKVMSFAIATYNPKGAPRGDQDPIIMVSMATSGGLRKVLSWKAPTAGLEFVETLEDEAAVLRRFEELVRQEDPDILVGYNTDNFDFPYLNQRLKALGIELALGRDGSPHKTSTRMGMSETRMAGRPHMDLYPIVRRSLRLPSYVLEDVVAEVLGEEKEKVPGERMGEIWDKGGEELDRFFRYSLEDAEVTLRIGEKYLPLYIELSRLVGQSIHDVARMTAGQLVEWYLMREAFARGEVIPERPGGREFARRAGDTYEGGYVREPRKGLLEKVFDFRSFAPSVIVTHNIDPSTIRPGPGENQPPGIDYHFTTEKEGFIPALLKRLVARRAELKEEMKKARDPGERKMLDVQQQALKILANSFYGYMGYPRARWYRKEAAESVSAFARDYIKKVMEVAEKEFGLEVVYGDTDSLFILVPGGKKERAFAFLEEVNRRLPGTIELEYEGFYRRGIFVTKKRYALIDEKDRIIVKGLEFVRRDWAPIARDTQEKVLKALLKDASPEEAVRIVRKAMDDIRARRVSLEDLTIYTQLTKK

SEQ ID NO: 2444 - protein, 687 aa, synthetic construct; identical to SEQ ID NO: 2441
  REGION 1..687: note = Description of Artificial Sequence: Synthetic polypeptide

SEQ ID NO: 2445 - protein, 687 aa, synthetic construct
  REGION 1..687: note = Description of Artificial Sequence: Synthetic polypeptide
MDGFLLDVDYKTVDEKPVVRLFLRDVIALDPSFRPYVYVAADDPRAVAGEIKDLELDGRRPVTGVEEMERGLLGRPRRFLKVYLGHPQQVPRVRDLLRRLPGVSAVLEDDILFSRRYLIDKGLVPTAWVELQGRVEGSEFWVEEVRRAEGPLPRLKVMSFAIATYNPKGAPRGDQDPIIMVSMATSGGLRKVLSWKAPTAGLEFVETLEDEAAVLRRFEELVRQEDPDILVGYNTDNFDFPYLNQRLKALGIELALGRDGSPHKTSTRMGMSETRMAGRPHMDLYPIVRRSLRLPSYVLEDVVAEVLGEEKEKVPGERMGEIWDKGGEELDRFFRYSLEDAEVTLRIGEKYLPLYIELSRLVGQSIHDVARMTAGQLVEWYLMREAFARGEVIPERPGGREFARRAGDTYEGGYVREPRKGLLEKVFDFRSYGPSVIVTHNIDPSTIRPGPGENQPPGIDYHFTTEKEGFIPALLKRLVARRAELKEEMKKARDPGERKMLDVQQQALKILANSFYGYMGYPRARWYRKEAAESVSAFARDYIKKVMEVAEKEFGLEVVYGDTDSLFILVPGGKKERAFAFLEEVNRRLPGTIELEYEGFYRRGIFVTKKRYALIDEKDRIIVKGLEFVRRDWAPIARDTQEKVLKALLKDASPEEAVRIVRKAMDDIRARRVSLEDLTIYTQLTKK

SEQ ID NO: 2446 - protein, 687 aa, synthetic construct
  REGION 1..687: note = Description of Artificial Sequence: Synthetic polypeptide
MDGFLLDVDYKTVDEKPVVRLFLRDVIALDPSFRPYVYVAADDPRAVAGEIKDLELDGRRPVTGVEEMERGLLGRPRRFLKVYLGHPQQVPRVRDLLRRLPGVSAVLEDDILFSRRYLIDKGLVPTAWVELQGRVEGSEFWVEEVRRAEGPLPRLKVMSFAIATYNPKGAPRGDQDPIIMVSMATSGGLRKVLSWKAPTAGLEFVETLEDEAAVLRRFEELVRQEDPDILVGYNTDNFDFPYLNQRLKALGIELALGRDGSPHKTSTRMGMSETRMAGRPHMDLYPIVRRSLRLPSYVLEDVVAEVLGEEKEKVPGERMGEIWDKGGEELDRFFRYSLEDAEVTLRIGEKYLPLYIELSRLVGQSIHDVARMTAGQLVEWYLMREAFARGEVIPERPGGREFARRAGDTYEGGYVREPRKGLLEKVFDFRSYAPSVIVTHNIDPSTIRPGPGENQPPGIDYHFTTEKEGFIPALLKRLVARRAELKEEMKKARDPGERKMLDVQQQALKILANSFYGYMGYPRARWYRKEAAESVSAFARDYIKKVMEVAEKEFGLEVVYGDTDSLFILVPGGKKERAFAFLEEVNRRLPGTIELEYEGFYRRGIFVTKKRYALIDEKDRIIVKGLEFVRRDWAPIARDTQEKVLKALLKDASPEEAVRIVRKAMDDIRARRVSLEDLTIYTQLTKK

SEQ ID NO: 2447 - protein, 687 aa, synthetic construct
  REGION 1..687: note = Description of Artificial Sequence: Synthetic polypeptide
MDGFLLDVDYKTVDEKPVVRLFLRDVIALDPSFRPYVYVAADDPRAVAGEIKDLELDGRRPVTGVEEMERGLLGRPRRFLKVYLGHPQQVPRVRDLLRRLPGVSAVLEDDILFSRRYLIDKGLVPTAWVELQGRVEGSEFWVEEVRRAEGPLPRLKVMSFAIATYNPKGAPRGDQDPIIMVSMATSGGLRKVLSWKAPTAGLEFVETLEDEAAVLRRFEELVRQEDPDILVGYNTDNFDFPYLNQRLKALGIELALGRDGSPHKTSTRMGMSETRMAGRPHMDLYPIVRRSLRLPSYVLEDVVAEVLGEEKEKVPGERMGEIWDKGGEELDRFFRYSLEDAEVTLRIGEKYLPLYIELSRLVGQSIHDVARMTAGQLVEWYLMREAFARGEVIPERPGGREFARRAGDTYEGGYVREPRKGLLEKVFDFRSAAASVIVTHNIDPSTIRPGPGENQPPGIDYHFTTEKEGFIPALLKRLVARRAELKEEMKKARDPGERKMLDVQQQALKILANSFYGYMGYPRARWYRKEAAESVSAFARDYIKKVMEVAEKEFGLEVVYGDTDSLFILVPGGKKERAFAFLEEVNRRLPGTIELEYEGFYRRGIFVTKKRYALIDEKDRIIVKGLEFVRRDWAPIARDTQEKVLKALLKDASPEEAVRIVRKAMDDIRARRVSLEDLTIYTQLTKK

SEQ ID NO: 2448 - protein, 687 aa, synthetic construct
  REGION 1..687: note = Description of Artificial Sequence: Synthetic polypeptide
MDGFLLDVDYKTVDEKPVVRLFLRDVIALDPSFRPYVYVAADDPRAVAGEIKDLELDGRRPVTGVEEMERGLLGRPRRFLKVYLGHPQQVPRVRDLLRRLPGVSAVLEDDILFSRRYLIDKGLVPTAWVELQGRVEGSEFWVEEVRRAEGPLPRLKVMSFAIATYNPKGAPRGDQDPIIMVSMATSGGLRKVLSWKAPTAGLEFVETLEDEAAVLRRFEELVRQEDPDILVGYNTDNFDFPYLNQRLKALGIELALGRDGSPHKTSTRMGMSETRMAGRPHMDLYPIVRRSLRLPSYVLEDVVAEVLGEEKEKVPGERMGEIWDKGGEELDRFFRYSLEDAEVTLRIGEKYLPLYIELSRLVGQSIHDVARMTAGQLVEWYLMREAFARGEVIPERPGGREFARRAGDTYEGGYVREPRKGLLEKVFDFRSYAGSVIVTHNIDPSTIRPGPGENQPPGIDYHFTTEKEGFIPALLKRLVARRAELKEEMKKARDPGERKMLDVQQQALKILANSFYGYMGYPRARWYRKEAAESVSAFARDYIKKVMEVAEKEFGLEVVYGDTDSLFILVPGGKKERAFAFLEEVNRRLPGTIELEYEGFYRRGIFVTKKRYALIDEKDRIIVKGLEFVRRDWAPIARDTQEKVLKALLKDASPEEAVRIVRKAMDDIRARRVSLEDLTIYTQLTKK

SEQ ID NO: 2449 - protein, 687 aa, synthetic construct
  REGION 1..687: note = Description of Artificial Sequence: Synthetic polypeptide
MDGFLLDVDFKTVDEKPVVRLFLRDVIALDPSFRPYVYVAADDPRAVAGEIKDLELDGRRPVTGVEEMERGLLGRPRRFLKVYLGHPQQVPRVRDLLRRLPGVSAVLEDDILFSRRYLIDKGLVPTAWVELQGRVEGSEFWVEEVRRAEGPLPRLKVMSFAIATYNPKGAPRGDQDPIIMVSMATSGGLRKVLSWKAPTAGLEFVETLEDEAAVLRRFEELVRQEDPDILVGYNTDNFDFPYLNQRLKALGIELALGRDGSPHKTSTRMGMSETRMAGRPHMDLYPIVRRSLRLPSYVLEDVVAEVLGEEKEKVPGERMGEIWDKGGEELDRFFRYSLEDAEVTLRIGEKYLPLYIELSRLVGQSIHDVARMTAGQLVEWYLMREAFARGEVIPERPGGREFARRAGDTYEGGYVREPRKGLLEKVFDFRSAAASVIVTHNIDPSTIRPGPGENQPPGIDYHFTTEKEGFIPALLKRLVARRAELKEEMKKARDPGERKMLDVQQQALKILANSFYGYMGYPRARWYRKEAAESVSAFARDYIKKVMEVAEKEFGLEVVYGDTDSLFILVPGGKKERAFAFLEEVNRRLPGTIELEYEGFYRRGIFVTKKRYALIDEKDRIIVKGLEFVRRDWAPIARDTQEKVLKALLKDASPEEAVRIVRKAMDDIRARRVSLEDLTIYTQLTKK

SEQ ID NO: 2450 - protein, 687 aa, synthetic construct
  REGION 1..687: note = Description of Artificial Sequence: Synthetic polypeptide
MDGFLLDVDYKTVDEKPVVRLFLRDVIALDPSFRPYVYVAADDPRAVAGEIKDLELDGRRPVTGVEEMERGLLGRPRRFLKVYLGHPQQVPRVRDLLRRLPGVSAVLEDDILFSRRYLIDKGLVPTAWVELQGRVEGSEFWVEEVRRAEGPLPRLKVMSFAIATYNPKGAPRGDQDPIIMVSMATSGGLRKVLSWKAPTAGLEFVETLEDEAAVLRRFEELVRQEDPDILVGYNTDNFDFPYLNQRLKALGIELALGRDGSPHKTSTRMGMSETRMAGRPHMDLYPIVRRSLRLPSYVLEDVVAEVLGEEKEKVPGERMGEIWDKGGEELDRFFRYSLEDAEVTLRIGEKYLPLYIELSRLVGQSIHDVARMTAGQLVEWYLMREAFARGEVIPERPGGREFARRAGDTYEGGYVREPRKGLLEKVFDFRSSAPSVIVTHNIDPSTIRPGPGENQPPGIDYHFTTEKEGFIPALLKRLVARRAELKEEMKKARDPGERKMLDVQQQALKILANSFYGYMGYPRARWYRKEAAESVSAFARDYIKKVMEVAEKEFGLEVVYGDTDSLFILVPGGKKERAFAFLEEVNRRLPGTIELEYEGFYRRGIFVTKKRYALIDEKDRIIVKGLEFVRRDWAPIARDTQEKVLKALLKDASPEEAVRIVRKAMDDIRARRVSLEDLTIYTQLTKK

SEQ ID NO: 2451 - protein, 687 aa, synthetic construct
  REGION 1..687: note = Description of Artificial Sequence: Synthetic polypeptide
MDGFLLDVDFKTVDEKPVVRLFLRDVIALDPSFRPYVYVAADDPRAVAGEIKDLELDGRRPVTGVEEMERGLLGRPRRFLKVYLGHPQQVPRVRDLLRRLPGVSAVLEDDILFSRRYLIDKGLVPTAWVELQGRVEGSEFWVEEVRRAEGPLPRLKVMSFAIATYNPKGAPRGDQDPIIMVSMATSGGLRKVLSWKAPTAGLEFVETLEDEAAVLRRFEELVRQEDPDILVGYNTDNFDFPYLNQRLKALGIELALGRDGSPHKTSTRMGMSETRMAGRPHMDLYPIVRRSLRLPSYVLEDVVAEVLGEEKEKVPGERMGEIWDKGGEELDRFFRYSLEDAEVTLRIGEKYLPLYIELSRLVGQSIHDVARMTAGQLVEWYLMREAFARGEVIPERPGGREFARRAGDTYEGGYVREPRKGLLEKVFDFRSYAGSVIVTHNIDPSTIRPGPGENQPPGIDYHFTTEKEGFIPALLKRLVARRAELKEEMKKARDPGERKMLDVQQQALKILANSFYGYMGYPRARWYRKEAAESVSAFARDYIKKVMEVAEKEFGLEVVYGDTDSLFILVPGGKKERAFAFLEEVNRRLPGTIELEYEGFYRRGIFVTKKRYALIDEKDRIIVKGLEFVRRDWAPIARDTQEKVLKALLKDASPEEAVRIVRKAMDDIRARRVSLEDLTIYTQLTKK

SEQ ID NO: 2452 - protein, 687 aa, synthetic construct
  REGION 1..687: note = Description of Artificial Sequence: Synthetic polypeptide
MDGFLLDVDYKTVDEKPVVRLFLRDVIALDPSFRPYVYVAADDPRAVAGEIKDLELDGRRPVTGVEEMERGLLGRPRRFLKVYLGHPQQVPRVRDLLRRLPGVSAVLEDDILFSRRYLIDKGLVPTAWVELQGRVEGSEFWVEEVRRAEGPLPRLKVMSFAIATYNPKGAPRGDQDPIIMVSMATSGGLRKVLSWKAPTAGLEFVETLEDEAAVLRRFEELVRQEDPDILVGYNTDNFDFPYLNQRLKALGIELALGRDGSPHKTSTRMGMSETRMAGRPHMDLYPIVRRSLRLPSYVLEDVVAEVLGEEKEKVPGERMGEIWDKGGEELDRFFRYSLEDAEVTLRIGEKYLPLYIELSRLVGQSIHDVARMTAGQLVEWYLMREAFARGEVIPERPGGREFARRAGDTYEGGYVREPRKGLLEKVFDFRSFGPSVIVTHNIDPSTIRPGPGENQPPGIDYHFTTEKEGFIPALLKRLVARRAELKEEMKKARDPGERKMLDVQQQALKILANSFYGYMGYPRARWYRKEAAESVSAFARDYIKKVMEVAEKEFGLEVVYGDTDSLFILVPGGKKERAFAFLEEVNRRLPGTIELEYEGFYRRGIFVTKKRYALIDEKDRIIVKGLEFVRRDWAPIARDTQEKVLKALLKDASPEEAVRIVRKAMDDIRARRVSLEDLTIYTQLTKK

SEQ ID NO: 2453 - protein, 687 aa, synthetic construct
  REGION 1..687: note = Description of Artificial Sequence: Synthetic polypeptide
MDGFLLDVDFKTVDEKPVVRLFLRDVIALDPSFRPYVYVAADDPRAVAGEIKDLELDGRRPVTGVEEMERGLLGRPRRFLKVYLGHPQQVPRVRDLLRRLPGVSAVLEDDILFSRRYLIDKGLVPTAWVELQGRVEGSEFWVEEVRRAEGPLPRLKVMSFAIATYNPKGAPRGDQDPIIMVSMATSGGLRKVLSWKAPTAGLEFVETLEDEAAVLRRFEELVRQEDPDILVGYNTDNFDFPYLNQRLKALGIELALGRDGSPHKTSTRMGMSETRMAGRPHMDLYPIVRRSLRLPSYVLEDVVAEVLGEEKEKVPGERMGEIWDKGGEELDRFFRYSLEDAEVTLRIGEKYLPLYIELSRLVGQSIHDVARMTAGQLVEWYLMREAFARGEVIPERPGGREFARRAGDTYEGGYVREPRKGLLEKVFDFRSFAPSVIVTHNIDPSTIRPGPGENQPPGIDYHFTTEKEGFIPALLKRLVARRAELKEEMKKARDPGERKMLDVQQQALKILANSFYGYMGYPRARWYRKEAAESVSAFARDYIKKVMEVAEKEFGLEVVYGDTDSLFILVPGGKKERAFAFLEEVNRRLPGTIELEYEGFYRRGIFVTKKRYALIDEKDRIIVKGLEFVRRDWAPIARDTQEKVLKALLKDASPEEAVRIVRKAMDDIRARRVSLEDLTIYTQLTKK

SEQ ID NO: 2454 - protein, 687 aa, synthetic construct; identical to SEQ ID NO: 2441
  REGION 1..687: note = Description of Artificial Sequence: Synthetic polypeptide

SEQ ID NO: 2455 - protein, 575 aa, Salasvirus phi29 [sequence omitted]

SEQ ID NO: 2456 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRKGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2457 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRRGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2458 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTKISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2459 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTRISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2460 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWKMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2461 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWRMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2462 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGKWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2463 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGRWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2464 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYKIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2465 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYRIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2466 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPKPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2467 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPRPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2468 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRKTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2469 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRRTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2470 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSKKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2471 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSRKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2472 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2473 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSSYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2474 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSIYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2475 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSFYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2476 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSMYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2477 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLAPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2478 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLGPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2479 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLSPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2480 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYSAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2481 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYTAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2482 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYAAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2483 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYGAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2484 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRKGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2485 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRRGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2486 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASKPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2487 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASRPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2488 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPKYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2489 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPRYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2490 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTKKIKKEVTFENFKVGFSRKMKPKPVQVPGGVVLVDDTFTIK

SEQ ID NO: 2491 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTRKIKKEVTFENFKVGFSRKMKPKPVQVPGGVVLVDDTFTIK

SEQ ID NO: 2492 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTNIQDIYMKEVDGKLVEGSPDDYTDIKFSVKCAGMTDKIKKEVTFENFKVGFSRKMKPKPVQVPGGVVLVDDTFTIK

SEQ ID NO: 2493 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTKIQDIYMKEVDGKLVEGSPDDYTDIKFSVKCAGMTDKIKKEVTFENFKVGFSRKMKPKPVQVPGGVVLVDDTFTIK

SEQ ID NO: 2494 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTRIQDIYMKEVDGKLVEGSPDDYTDIKFSVKCAGMTDKIKKEVTFENFKVGFSRKMKPKPVQVPGGVVLVDDTFTIK

SEQ ID NO: 2495 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKSVQVPGGVVLVDDTFTIK

SEQ ID NO: 2496 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKTVQVPGGVVLVDDTFTIK

SEQ ID NO: 2497 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKKVQVPGGVVLVDDTFTIK

SEQ ID NO: 2498 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQSAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2499 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQVAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2500 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQGAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2501 - protein, 575 aa, synthetic construct
  REGION 1..575: note = Description of Artificial Sequence: Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQAAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 2502 - protein, 876 aa, Geobacillus stearothermophilus
MKKKLVLIDGNSVAYRAFFALPLLHNDKGIHTNAVYGFTMMLNKILAEEQPTHLLVAFDAGKTTFRHETFQEYKGGRQQTPPELSEQFPLLRELLKAYRIPAYELDHYEADDIIGTLAARAEQEGFEVKIISGDRDLTQLASRHVTVDITKKGITDIEPYTPETVREKYGLTPEQIVDLKGLMGDKSDNIPGVPGIGEKTAVKLLKQFGTVENVLASIDEVKGEKLKENLRQHRDLALLSKQLASICRDAPVELSLDDIVYEGQDREKVIALFKELGFQSFLEKMAAPAAEGEKPLEEMEFAIVDVITEEMLADKAALVVEVMEENYHDAPIVGIALVNEHGRFFMRPETALADSQFLAWLADETKKKSMFDAKRAVVALKWKGIELRGVAFDLLLAAYLLNPAQDAGDIAAVAKMKQYEAVRSDEAVYGKGVKRSLPDEQTLAEHLVRKAAAIWALEQPFMDDLRNNEQDQLLTKLEQPLAAILAEMEFTGVNVDTKRLEQMGSELAEQLRAIEQRIYELAGQEFNINSPKQLGVILFEKLQLPVLKKTKTGYSTSADVLEKLAPHHEIVENILHYRQLGKLQSTYIEGLLKVVRPDTGKVHTMFNQALTQTGRLSSAEPNLQNIPIRLEEGRKIRQAFVPSEPDWLIFAADYSQIELRVLAHIADDDNLIEAFQRDLDIHTKTAMDIFHVSEEEVTANMRRQAKAVNFGIVYGISDYGLAQNLNITRKEAAEFIERYFASFPGVKQYMENIVQEAKQKGYVTTLLHRRRYLPDITSRNFNVRSFAERTAMNTPIQGSAADIIKKAMIDLAARLKEEQLQARLLLQVHDELILEAPKEEIERLCELVPEVMEQAVTLRVPLKVDYHYGPTWYDAK

SEQ ID NO: 2503 - protein, 775 aa, synthetic construct
  REGION 1..775: note = Description of Artificial Sequence: Synthetic polypeptide
MILDTDYITENGKPVIRVFKKENGEFKIEYDRTFEPYFYALLKDDSAIEDVKKVTAKRHGTVVKVKRAEKVQKKFLGRPIEVWKLYFNHPQDVPAIRDRIRAHPAVVDIYEYDIPFAKRYLIDKGLIPAEGDEELTMLAFDIETLYHEGEEFGTGPILMISYADGSEARVITWKKIDLPYVDVVSTEKEMIKRFLRVVREKDPDVLITYNGDNFDFAYLKKRCEELGIKFTLGRDGSEPKIQRMGDRFAVEVKGRIHFDLYPVIRRTINLPTYTLEAVYEAVFGKPKEKVYAEEIAQAWESGEGLERVARYSMEDAKVTYELGREFFPMEAQLSRLIGQSLWDVSRSSTGNLVEWFLLRKAYKRNELAPNKPDERELARRRGGYAGGYVKEPERGLWDNIVYLDFRSLYPSIIITHNVSPDTLNREGCKEYDVAPEVGHKFCKDFPGFIPSLLGDLLEERQKIKRKMKATVDPLEKKLLDYRQRAIKILANSFYGYYGYAKARWYCKECAESVTAWGREYIEMVIRELEEKFGFKVLYADTDGLHATIPGADAETVKKKAKEFLKYINPKLPGLLELEYEGFYVRGFFVTKKKYAVIDEEGKITTRGLEIVRRDWSEIAKETQARVLEAILKHGDVEEAVRIVKEVTEKLSKYEVPPEKLVIHEQITRDLRDYKATGPHVAVAKRLAARGVKIRPGTVISYIVLKGSGRIGDRAIPADEFDPTKHRYDAEYYIENQVLPAVERILKAFGYRKEDLRYQKTKQVGLGAWLKVKGKK

SEQ ID NO: 2504 - protein, 775 aa, Thermococcus sp.
MILDTDYITENGKPVIRVFKKENGEFKIEYDRTFEPYFYALLKDDSAIEDVKKVTAKRHGTVVKVKRAEKVQKKFLGRPIEVWKLYFNHPQDVPAIRDRIRAHPAVVDIYEYDIPFAKRYLIDKGLIPMEGDEELTMLAFDIETLYHEGEEFGTGPILMISYADGSEARVITWKKIDLPYVDVVSTEKEMIKRFLRVVREKDPDVLITYNGDNFDFAYLKKRCEELGIKFTLGRDGSEPKIQRMGDRFAVEVKGRIHFDLYPVIRRTINLPTYTLEAVYEAVFGKPKEKVYAEEIAQAWESGEGLERVARYSMEDAKVTYELGREFFPMEAQLSRLIGQSLWDVSRSSTGNLVEWFLLRKAYKRNELAPNKPDERELARRRGGYAGGYVKEPERGLWDNIVYLDFRSLYPSIIITHNVSPDTLNREGCKEYDVAPEVGHKFCKDFPGFIPSLLGDLLEERQKIKRKMKATVDPLEKKLLDYRQRAIKILANSFYGYYGYAKARWYCKECAESVTAWGREYIEMVIRELEEKFGFKVLYADTDGLHATIPGADAETVKKKAKEFLKYINPKLPGLLELEYEGFYVRGFFVTKKKYAVIDEEGKITTRGLEIVRRDWSEIAKETQARVLEAILKHGDVEEAVRIVKEVTEKLSKYEVPPEKLVIHEQITRDLRDYKATGPHVAVAKRLAARGVKIRPGTVISYIVLKGSGRIGDRAIPADEFDPTKHRYDAEYYIENQVLPAVERILKAFGYRKEDLRYQKTKQVGLGAWLKVKGKK

SEQ ID NO: 2505 - protein, 775 aa, synthetic construct
  REGION 1..775: note = Description of Artificial Sequence: Synthetic polypeptide
MILDTDYITENGKPVIRVFKKENGEFKIEYDRTFEPYFYALLKDDSAIEDVKKVTAKRHGTVVKVKRAEKVQKKFLGRPIEVWKLYFNHPQDVPAIRDRIRAHPAVVDIYEYDIPFAKRYLIDKGLIPMEGDEELTMLAFAIATLYHEGEEFGTGPILMISYADGSEARVITWKKIDLPYVDVVSTEKEMIKRFLRVVREKDPDVLITYNGDNFDFAYLKKRCEELGIKFTLGRDGSEPKIQRMGDRFAVEVKGRIHFDLYPVIRRTINLPTYTLEAVYEAVFGKPKEKVYAEEIAQAWESGEGLERVARYSMEDAKVTYELGREFFPMEAQLSRLIGQSLWDVSRSSTGNLVEWFLLRKAYKRNELAPNKPDERELARRRGGYAGGYVKEPERGLWDNIVYLDFRSLYPSIIITHNVSPDTLNREGCKEYDVAPEVGHKFCKDFPGFIPSLLGDLLEERQKIKRKMKATVDPLEKKLLDYRQRLIKILANSFYGYYGYAKARWYCKECAESVTAWGREYIEMVIRELEEKFGFKVLYADTDGLHATIPGADAETVKKKAKEFLKYINPKLPGLLELEYEGFYVRGFFVTKKKYAVIDEEGKITTRGLEIVRRDWSEIAKETQARVLEAILKHGDVEEAVRIVKEVTEKLSKYEVPPEKLVIHEQITRDLRDYKATGPHVAVAKRLAARGVKIRPGTVISYIVLKGSGRIGDRAIPADEFDPTKHRYDAEYYIENQVLPAVERILKAFGYRKEDLRYQKTKQVGLGAWLKVKGKK

SEQ ID NO: 2506 - protein, 1702 aa, Thermococcus litoralis
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRGKIREHPAVVDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKEHPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCKNYDVAPIVGYRFCKDFPGFIPSILGDLIAMRQDIKKKMKSTIDPIEKKMLDYRQRAIKLLANSILPNEWLPIIENGEIKFVKIGEFINSYMEKQKENVKTVENTEVLEVNNLFAFSFNKKIKESEVKKVKALIRHKYKGKAYEIQLSSGRKINITAGHSLFTVRNGEIKEVSGDGIKEGDLIVAPKKIKLNEKGVSINIPELISDLSEEETADIVMTISAKGRKNFFKGMLRTLRWMFGEENRRIRTFNRYLFHLEKLGLIKLLPRGYEVTDWERLKKYKQLYEKLAGSVKYNGNKREYLVMFNEIKDFISYFPQKELEEWKIGTLNGFRTNCILKVDEDFGKLLGYYVSEGYAGAQKNKTGGISYSVKLYNEDPNVLESMKNVAEKFFGKVRVDRNCVSISKKMAYLVMKCLCGALAENKRIPSVILTSPEPVRWSFLEAYFTGDGDIHPSKRFRLSTKSELLANQLVFLLNSLGISSVKIGFDSGVYRVYINEDLQFPQTSREKNTYYSNLIPKEILRDVFGKEFQKNMTFKKFKELVDSGKLNREKAKLLEFFINGDIVLDRVKSVKEKDYEGYVYDLSVEDNENFLVGFGLLYAHNSYYGYMGYPKARWYSKECAESVTAWGRHYIEMTIREIEEKFGFKVLYADSVSGESEIIIRQNGKIRFVKIKDLFSKVDYSIGEKEYCILEGVEALTLDDDGKLVWKPVPYVMRHRANKRMFRIWLTNSWYIDVTEDHSLIGYLNTSKTKTAKKIGERLKEVKPFELGKAVKSLICPNAPLKDENTKTSEIAVKFWELVGLIVGDGNWGGDSRWAEYYLGLSTGKDAEEIKQKLLEPLKTYGVISNYYPKNEKGDFNILAKSLVKFMKRHFKDEKGRRKIPEFMYELPVTYIEAFLRGLFSADGTVTIRKGVPEIRLTNIDADFLREVRKLLWIVGISNSIFAETTPNRYNGVSTGTYSKHLRIKNKWRFAERIGFLIERKQKRLLEHLKSARVKRNTIDFGFDLVHVKKVEEIPYEGYVYDIEVEETHRFFANNILVHNTDGFYATIPGEKPELIKKKAKEFLNYINSKLPGLLELEYEGFYLRGFFVTKKRYAVIDEEGRITTRGLEVVRRDWSEIAKETQAKVLEAILKEGSVEKAVEVVRDVVEKIAKYRVPLEKLVIHEQITRDLKDYKAIGPHVAIAKRLAARGIKVKPGTIISYIVLKGSGKISDRVILLTEYDPRKHKYDPDYYIENQVLPAVLRILEAFGYRKEDLRYQSSKQTGLDAWLKR

SEQ ID NO: 2507 - protein, 1312 aa, Pyrococcus sp.
MILDADYITEDGKPIIRIFKKENGEFKVEYDRNFRPYIYALLKDDSQIDEVRKITAERHGKIVRIIDAEKVRKKFLGRPIEVWRLYFEHPQDVPAIRDKIREHSAVIDIFEYDIPFAKRYLIDKGLIPMEGDEELKLLAFDIETLYHEGEEFAKGPIIMISYADEEEAKVITWKKIDLPYVEVVSSEREMIKRFLKVIREKDPDVIITYNGDSFDLPYLVKRAEKLGIKLPLGRDGSEPKMQRLGDMTAVEIKGRIHFDLYHVIRRTINLPTYTLEAVYEAIFGKPKEKVYAHEIAEAWETGKGLERVAKYSMEDAKVTYELGREFFPMEAQLSRLVGQPLWDVSRSSTGNLVEWYLLRKAYERNELAPNKPDEREYERRLRESYAGGYVKEPEKGLWEGLVSLDFRSLYPSIIITHNVSPDTLNREGCREYDVAPEVGHKFCKDFPGFIPSLLKRLLDERQEIKRKMKASKDPIEKKMLDYRQRAIKILANSILPEEWVPLIKNGKVKIFRIGDFVDGLMKANQGKVKKTGDTEVLEVAGIHAFSFDRKSKKARVMAVKAVIRHRYSGNVYRIVLNSGRKITITEGHSLFVYRNGDLVEATGEDVKIGDLLAVPRSVNLPEKRERLNIVELLLNLSPEETEDIILTIPVKGRKNFFKGMLRTLRWIFGEEKRVRTASRYLRHLENLGYIRLRKIGYDIIDKEGLEKYRTLYEKLVDVVRYNGNKREYLVEFNAVRDVISLMPEEELKEWRIGTRNGFRMGTFVDIDEDFAKLLGYYVSEGSARKWKNQTGGWSYTVRLYNENDEVLDDMEHLAKKFFGKVKRGKNYVEIPKKMAYIIFESLCGTLAENKRVPEVIFTSSKGVRWAFLEGYFIGDGDVHPSKRVRLSTKSELLVNGLVLLLNSLGVSAIKLGYDSGVYRVYVNEELKFTEYRKKKNVYHSHIVPKDILKETFGKVFQKNISYKKFRELVENGKLDREKAKRIEWLLNGDIVLDRVVEIKREYYDGYVYDLSVDEDENFLAGFGFLYAHNSYYGYYGYAKARWYCKECAESVTAWGREYIEFVRKELEEKFGFKVLYIDTDGLYATIPGAKPEEIKKKALEFVDYINAKLPGLLELEYEGFYVRGFFVTKKKYALIDEEGKIITRGLEIVRRDWSEIAKETQAKVLEAILKHGNVEEAVKIVKEVTEKLSKYEIPPEKLVIYEQITRPLHEYKAIGPHVAVAKRLAARGVKVRPGMVIGYIVLRGDGPISKRAILAEEFDLRKHKYDAEYYIENQVLPAVLRILEAFGYRKEDLRWQKTKQTGLTAWLNIKKK

SEQ ID NO: 2508 - protein, 775 aa, Pyrococcus furiosus
MILDVDYITEEGKPVIRLFKKENGKFKIEHDRTFRPYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRALYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTRQVGLTSWLNIKKS

SEQ ID NO: 2509 - protein, 771 aa, Pyrococcus abyssi
MIIDADYITEDGKPIIRIFKKEKGEFKVEYDRTFRPYIYALLKDDSAIDEVKKITAERHGKIVRITEVEKVQKKFLGRPIEVWKLYLEHPQDVPAIREKIREHPAVVDIFEYDIPFAKRYLIDKGLTPMEGNEELTFLAVDIETLYHEGEEFGKGPIIMISYADEEGAKVITWKSIDLPYVEVVSSEREMIKRLVKVIREKDPDVIITYNGDNFDFPYLLKRAEKLGIKLPLGRDNSEPKMQRMGDSLAVEIKGRIHFDLFPVIRRTINLPTYTLEAVYEAIFGKSKEKVYAHEIAEAWETGKGLERVAKYSMEDAKVTFELGKEFFPMEAQLARLVGQPVWDVSRSSTGNLVEWFLLRKAYERNELAPNKPDEREYERRLRESYEGGYVKEPEKGLWEGIVSLDFRSLYPSIIITHNVSPDTLNRENCKEYDVAPQVGHRFCKDFPGFIPSLLGNLLEERQKIKKRMKESKDPVEKKLLDYRQRAIKILANSYYGYYGYAKARWYCKECAESVTAWGRQYIDLVRRELESRGFKVLYIDTDGLYATIPGAKHEEIKEKALKFVEYINSKLPGLLELEYEGFYARGFFVTKKKYALIDEEGKIVTRGLEIVRRDWSEIAKETQAKVLEAILKHGNVDEAVKIVKEVTEKLSKYEIPPEKLVIYEQITRPLSEYKAIGPHVAVAKRLAAKGVKVKPGMVIGYIVLRGDGPISKRAIAIEEFDPKKHKYDAEYYIENQVLPAVERILRAFGYRKEDLKYQKTKQVGLGAWLKF

SEQ ID NO: 2510 - protein, 903 aa, unidentified
  REGION 1..903: note = Description of Unknown: Escherichia virus RB69 sequence
MKEFYLTVEQIGDSIFERYIDSNGRERTREVEYKPSLFAHCPESQATKYFDIYGKPCTRKLFANMRDASQWIKRMEDIGLEALGMDDFKLAYLSDTYNYEIKYDHTKIRVANFDIEVTSPDGFPEPSQAKHPIDAITHYDSIDDRFYVFDLLNSPYGNVEEWSIEIAAKLQEQGGDEVPSEIIDKIIYMPFDNEKELLMEYLNFWQQKTPVILTGWNVESFDIPYVYNRIKNIFGESTAKRLSPHRKTRVKVIENMYGSREIITLFGISVLDYIDLYKKFSFTNQPSYSLDYISEFELNVGKLKYDGPISKLRESNHQRYISYNIIDVYRVLQIDAKRQFINLSLDMGYYAKIQIQSVFSPIKTWDAIIFNSLKEQNKVIPQGRSHPVQPYPGAFVKEPIPNRYKYVMSFDLTSLYPSIIRQVNISPETIAGTFKVAPLHDYINAVAERPSDVYSCSPNGMMYYKDRDGVVPTEITKVFNQRKEHKGYMLAAQRNGEIIKEALHNPNLSVDEPLDVDYRFDFSDEIKEKIKKLSAKSLNEMLFRAQRTEVAGMTAQINRKLLINSLYGALGNVWFRYYDLRNATAITTFGQMALQWIERKVNEYLNEVCGTEGEAFVLYGDTDSIYVSADKIIDKVGESKFRDTNHWVDFLDKFARERMEPAIDRGFREMCEYMNNKQHLMFMDREAIAGPPLGSKGIGGFWTGKKRYALNVWDMEGTRYAEPKLKIMGLETQKSSTPKAVQKALKECIRRMLQEGEESLQEYFKEFEKEFRQLNYISIASVSSANNIAKYDVGGFPGPKCPFHIRGILTYNRAIKGNIDAPQVVEGEKVYVLPLREGNPFGDKCIAWPSGTEITDLIKDDVLHWMDYTVLLEKTFIKPLEGFTSAAKLDYEKKASLFDMFDF

SEQ ID NO: 2511 - protein, 774 aa, synthetic construct
  REGION 1..774: note = Description of Artificial Sequence: Synthetic polypeptide
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFAIATFYHEGDEFGKGEIIMISYADEEEARVITWKNIDLPYVDVVSNEREMIKRFVQVVKEKDPDVIITYNGDNFDLPYLIKRAEKLGIRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSAAASIIVTHNVSPDTLEKEGCENYDIAPIVGYKFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGGGRISDRVILLTEYDPEKHKYDPDYYIENQVLPAVLRILEAFGYRKEDLRYQSSKQTGLDAWLKR

SEQ ID NO: 2512 - protein, 774 aa, synthetic construct
  REGION 1..774: note = Description of Artificial Sequence: Synthetic polypeptide
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFAIATFYHEGDEFGKGEIIMISYADEEEARVITWKNIDLPYVDVVSNEREMIKRFVQVVKEKDPDVIITYNGDNFDLPYLIKRAEKLGIRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSSAGSIIVTHNVSPDTLEKEGCENYDIAPIVGYKFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGGGRISDRVILLTEYDPEKHKYDPDYYIENQVLPAVLRILEAFGYRKEDLRYQSSKQTGLDAWLKR

SEQ ID NO: 2513 - protein, 774 aa, synthetic construct
  REGION 1..774: note = Description of Artificial Sequence: Synthetic polypeptide
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFAIATFYHEGDEFGKGEIIMISYADEEEARVITWKNIDLPYVDVVSNEREMIKRFVQVVKEKDPDVIITYNGDNFDLPYLIKRAEKLGIRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSSAPSIIVTHNVSPDTLEKEGCENYDIAPIVGYKFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGGGRISDRVILLTEYDPEKHKYDPDYYIENQVLPAVLRILEAFGYRKEDLRYQSSKQTGLDAWLKR

SEQ ID NO: 2514 - protein, 774 aa, synthetic construct
  REGION 1..774: note = Description of Artificial Sequence: Synthetic polypeptide
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFAIATFYHEGDEFGKGEIIMISYADEEEARVITWKNIDLPYVDVVSNEREMIKRFVQVVKEKDPDVIITYNGDNFDLPYLIKRAEKLGIRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSSGPSIIVTHNVSPDTLEKEGCENYDIAPIVGYKFCKDFPGFIPSILGDLIAMRQEIKKKMKATIDPIEKKMLDYRQRAVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGGGRISDRVILLTEYDPEKHKYDPDYYIENQVLPAVLRILEAFGYRKEDLRYQSSKQTGLDAWLKR

SEQ ID NO: 2515 - protein, 774 aa, synthetic construct
  REGION 1..774: note = Description of Artificial Sequence: Synthetic polypeptide
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFAIATFYHEGDEFGKGEIIMISYADEEEARVITWKNIDLPYVDVVSNEREMIKRFVQVVKEKDPDVIITYNGDNFDLPYLIKRAEKLGIRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSAAASIIVTHNVSPDTLEKEGCENYDIAPIVGYKFCKDFPGFIPSILGDLIAMRQEIKKKMKATIDPIEKKMLDYRQRSVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGGGRISDRVILLTEYDPEKHKYDPDYYIENQVLPAVLRILEAFGYRKEDLRYQSSKQTGLDAWLKR

SEQ ID NO: 2516 - protein, 774 aa, synthetic construct
  REGION 1..774: note = Description of Artificial Sequence: Synthetic polypeptide
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFAIATFYHEGDEFGKGEIIMISYADEEEARVITWKNIDLPYVDVVSNEREMIKRFVQVVKEKDPDVIITYNGDNFDLPYLIKRAEKLGIRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSSAGSIIVTHNVSPDTLEKEGCENYDIAPIVGYKFCKDFPGFIPSILGDLIAMRQEIKKKMKATIDPIEKKMLDYRQRSVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGGGRISDRVILLTEYDPEKHKYDPDYYIENQVLPAVLRILEAFGYRKEDLRYQSSKQTGLDAWLKR

SEQ ID NO: 2517 - protein, 774 aa, synthetic construct
  REGION 1..774: note = Description of Artificial Sequence: Synthetic polypeptide
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFAIATFYHEGDEFGKGEIIMISYADEEEARVITWKNIDLPYVDVVSNEREMIKRFVQVVKEKDPDVIITYNGDNFDLPYLIKRAEKLGIRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSSAPSIIVTHNVSPDTLEKEGCENYDIAPIVGYKFCKDFPGFIPSILGDLIAMRQEIKKKMKATIDPIEKKMLDYRQRSVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGGGRISDRVILLTEYDPEKHKYDPDYYIENQVLPAVLRILEAFGYRKEDLRYQSSKQTGLDAWLKR

SEQ ID NO: 2518 - protein, 774 aa, synthetic construct
  REGION 1..774: note = Description of Artificial Sequence: Synthetic polypeptide
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFAIATFYHEGDEFGKGEIIMISYADEEEARVITWKNIDLPYVDVVSNEREMIKRFVQVVKEKDPDVIITYNGDNFDLPYLIKRAEKLGIRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSSGPSIIVTHNVSPDTLEKEGCENYDIAPIVGYKFCKDFPGFIPSILGDLIAMRQEIKKKMKATIDPIEKKMLDYRQRSVKLLANSYYGYMGYPKARWYSKECAESVTAWGRHYIEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGGGRISDRVILLTEYDPEKHKYDPDYYIENQVLPAVLRILEAFGYRKEDLRYQSSKQTGLDAWLKR

SEQ ID NO: 2519 - protein, 774 aa, synthetic construct
  REGION 1..774: note = Description of Artificial Sequence: Synthetic polypeptide
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFAIATFYHEGDEFGKGEIIMISYADEEEARVITWKNIDLPYVDVVSNEREMIKRFVQVVKEKDPDVIITYNGDNFDLPYLIKRAEKLGIRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSAAASIIVTHNVSPDTLEKEGCENYDIAPIVGYKFCKDFPGFIPSILGDLIAMRQEIKKKMKATIDPIEKKMLDYRQRAVKLLANSYYGYMGYPKARWYSKECAESVTAWGRHYHEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGGGRISDRVILLTEYDPEKHKYDPDYYIENQVLPAVLRILEAFGYRKEDLRYQSSKQTGLDAWLKR

SEQ ID NO: 2520 - protein, 774 aa, synthetic construct
  REGION 1..774: note = Description of Artificial Sequence: Synthetic polypeptide
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFAIATFYHEGDEFGKGEIIMISYADEEEARVITWKNIDLPYVDVVSNEREMIKRFVQVVKEKDPDVIITYNGDNFDLPYLIKRAEKLGIRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSSAGSIIVTHNVSPDTLEKEGCENYDIAPIVGYKFCKDFPGFIPSILGDLIAMRQEIKKKMKATIDPIEKKMLDYRQRAVKLLANSYYGYMGYPKARWYSKECAESVTAWGRHYHEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGGGRISDRVILLTEYDPEKHKYDPDYYIENQVLPAVLRILEAFGYRKEDLRYQSSKQTGLDAWLKR

SEQ ID NO: 2521 - protein, 774 aa, synthetic construct
  REGION 1..774: note = Description of Artificial Sequence: Synthetic polypeptide
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFAIATFYHEGDEFGKGEIIMISYADEEEARVITWKNIDLPYVDVVSNEREMIKRFVQVVKEKDPDVIITYNGDNFDLPYLIKRAEKLGIRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSSAPSIIVTHNVSPDTLEKEGCENYDIAPIVGYKFCKDFPGFIPSILGDLIAMRQEIKKKMKATIDPIEKKMLDYRQRAVKLLANSYYGYMGYPKARWYSKECAESVTAWGRHYHEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGGGRISDRVILLTEYDPEKHKYDPDYYIENQVLPAVLRILEAFGYRKEDLRYQSSKQTGLDAWLKR

SEQ ID NO: 2522 - protein, 774 aa, synthetic construct
  REGION 1..774: note = Description of Artificial Sequence: Synthetic polypeptide
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFAIATFYHEGDEFGKGEIIMISYADEEEARVITWKNIDLPYVDVVSNEREMIKRFVQVVKEKDPDVIITYNGDNFDLPYLIKRAEKLGIRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSSGPSIIVTHNVSPDTLEKEGCENYDIAPIVGYKFCKDFPGFIPSILGDLIAMRQEIKKKMKATIDPIEKKMLDYRQRAVKLLANSYYGYMGYPKARWYSKECAESVTAWGRHYHEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGGGRISDRVILLTEYDPEKHKYDPDYYIENQVLPAVLRILEAFGYRKEDLRYQSSKQTGLDAWLKR

SEQ ID NO: 2523 - protein, 774 aa, synthetic construct
  REGION 1..774: note = Description of Artificial Sequence: Synthetic polypeptide
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRDKIKEHPAVIDIYEYDIPFAKRYLIDKGLIPMEGDEELKLLAFAIATFYHEGDEFGKGEIIMISYADEEEARVITWKNIDLPYVDVVSNEREMIKRFVQVVKEKDPDVIITYNGDNFDLPYLIKRAEKLGIRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSSAPSIIVTHNVSPDTLEKEGCENYDIAPIVGYKFCKDFPGFIPSILGDLIAMRQEIKKKMKATIDPIEKKMLDYRQRSVKLLANSYYGYMGYPKARWYSLECAESVTAWGRHYHEMTIKEIEEKFGFKVLYADTDGFYATIPGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVVEKIAKYRVPLEKLVIHEQITRDLKDYKAIGPHVSIAKRLATRGIKVKPGTIISYLVLKGGGRISDRVILLTEYDPEKHKYDPDYYIENQVLPAVLRILEAFGYRKEDLRYQSSKQTGLDAWLKR

SEQ ID NO: 2524 - protein, 6 aa, synthetic construct
  REGION 1..6: note = Description of Artificial Sequence: Synthetic 6xHis tag
HHHHHH
